(12) United States Patent
Dairi et al.

(10) Patent No.: US 12,241,101 B2
(45) Date of Patent: Mar. 4, 2025

(54) MICROORGANISM PRODUCING POLYUNSATURATED FATTY ACID AND METHOD FOR PRODUCING POLYUNSATURATED FATTY ACID

(71) Applicant: KYOWA HAKKO BIO CO., LTD., Tokyo (JP)

(72) Inventors: Tohru Dairi, Sapporo (JP); Yasuharu Satoh, Sapporo (JP); Shohei Hayashi, Sapporo (JP); Yasushi Ogasawara, Sapporo (JP); Tetsuro Ujihara, Tokyo (JP)

(73) Assignee: KYOWA HAKKO BIO CO., LTD., Tokyo (JP)

( * ) Notice: Subject to any disclaimer, the term of this patent is extended or adjusted under 35 U.S.C. 154(b) by 0 days.

(21) Appl. No.: 17/266,976

(22) PCT Filed: Aug. 9, 2019

(86) PCT No.: PCT/JP2019/031649
§ 371 (c)(1),
(2) Date: Feb. 8, 2021

(87) PCT Pub. No.: WO2020/032258
PCT Pub. Date: Feb. 13, 2020

(65) Prior Publication Data
US 2021/0309987 A1    Oct. 7, 2021

(30) Foreign Application Priority Data
Aug. 10, 2018 (JP) ................ 2018-151233

(51) Int. Cl.
*C12P 7/6427* (2022.01)
*C12N 9/00* (2006.01)
*C12N 9/02* (2006.01)
*C12N 9/10* (2006.01)
*C12N 9/12* (2006.01)

(52) U.S. Cl.
CPC .............. *C12N 9/93* (2013.01); *C12N 9/001* (2013.01); *C12N 9/1029* (2013.01); *C12N 9/1288* (2013.01); *C12P 7/6427* (2013.01); *C12Y 103/01009* (2013.01); *C12Y 203/01038* (2013.01); *C12Y 203/01041* (2013.01); *C12Y 207/08007* (2013.01)

(58) Field of Classification Search
None
See application file for complete search history.

(56) References Cited

U.S. PATENT DOCUMENTS

| | | | |
|---|---|---|---|
| 6,566,583 B1 | 5/2003 | Facciotti et al. | |
| 7,897,844 B2 | 3/2011 | Metz et al. | |
| 8,309,796 B2 * | 11/2012 | Weaver | A61P 25/24 800/298 |
| 11,613,728 B2 * | 3/2023 | Dairi | C12N 15/52 435/134 |
| 2008/0022422 A1 | 1/2008 | Weaver et al. | |
| 2008/0038793 A1 | 2/2008 | Metz et al. | |
| 2008/0038799 A1 | 2/2008 | Weaver et al. | |
| 2008/0166781 A1 | 7/2008 | Higashiyama et al. | |
| 2009/0068712 A1 | 3/2009 | Terashita et al. | |
| 2009/0093033 A1 | 4/2009 | Luy et al. | |
| 2009/0162908 A1 | 6/2009 | Yampolskaya et al. | |
| 2010/0093044 A1 | 4/2010 | Terashita et al. | |
| 2014/0147909 A1 | 5/2014 | Yampolskaya et al. | |

FOREIGN PATENT DOCUMENTS

| | | | |
|---|---|---|---|
| CN | 1535312 A | 10/2004 | |
| CN | 101087882 A | 12/2007 | |
| CN | 101939412 A | 1/2011 | |
| EP | 2366772 B1 | 1/2016 | |
| JP | 2006-219528 A | 8/2006 | |
| JP | 2017-184690 A | 10/2017 | |
| WO | WO 2002/083870 A2 | 10/2002 | |
| WO | WO 2004/087879 A2 | 10/2004 | |
| WO | WO 2008/144473 A2 | 11/2008 | |
| WO | WO 2011/146524 A1 | 11/2011 | |
| WO | WO-2015025920 A1 * | 2/2015 | C12N 15/52 |

OTHER PUBLICATIONS

Ngo et al. in The Protein Folding Problem and Tertiary Structure Prediction, 1994, Merz et al. (ed.), Birkhauser, Boston, MA, pp. 433 and 492-495.*
Fiers et al., J. Am. Chem. Soc. 138(49), pp. 16024-16036, Dec. 14, 2016.*
Agostoni et al., "Effects of Diet on the Lipid and Fatty Acid Status of Full-term Infants at 4 Months," *J. Am. Coll. Nutr.*, 13(6): 658-684 (1994).
Hayahshi et al., "Enhanced production of polyunsaturated fatty acids by enzyme engineering of tandem acyl carrier proteins," *Sci. Rep.*, 6: 35441 (2016).
Koletzko et al., "Arachidonic Acid and Early Human Growth: Is there a Relation?," *Ann. Nutr. Metab.*, 35(3): 128-131 (1991).
Metz et al., "Production of Polyunsaturated Fatty Acids by Polyketide Synthases in Both Prokaryotes and Eukaryotes," *Science*, 293(5528): 290-293 (2001).
Metz et al., "Biochemical characterization of polyunsaturated fatty acid synthesis in Schizochytrium: Release of the products as free fatty acids," *Plant Physiol. Biochem.*, 47(6): 472-478 (2009).
Orikasa et al., "pfaB products determine the molecular species produced in bacterial polyunsaturated fatty acid biosynthesis," *FEMS Microbiol. Lett.*, 295(2): 170-176 (2009).

(Continued)

Primary Examiner — Richard G Hutson
(74) Attorney, Agent, or Firm — Leydig, Voit & Mayer, Ltd.

(57) ABSTRACT

An object of the present invention is to provide a microorganism that efficiently produces a PUFA and a method for producing a PUFA using the microorganism. The present invention relates to a microorganism capable of producing a polyunsaturated fatty acid (PUFA), in which a gene encoding an exogenous polyketide synthase dehydratase (PS-DH) domain having a higher activity against 3-hydroxyhexanoyl acyl carrier protein (3-hydroxyhexanoyl ACP) than an endogenous FabA-like β-hydroxyacyl-ACP dehydratase (FabA-DH) domain has been introduced into a microorganism having a PUFA metabolic pathway, and the like.

11 Claims, 1 Drawing Sheet

Specification includes a Sequence Listing.

(56) References Cited

OTHER PUBLICATIONS

Shulse et al., "Widespread Occurrence of Secondary Lipid Biosynthesis Potential in Microbial Lineages," *PLoS One*, 6: e20146 (2011).
Wakil et al., "Fatty Acid Synthesis and its Regulation," *Annu. Rev. Biochem.*, 52: 537-579 (1983).
Xie et al., "Functional analysis of the dehydratase domains of a PUFA synthase from *Thraustochytrium* in *Escherichia coli*," *Appl. Microbiol. Biotechnol.*, 102(2): 847-856 (2018).
Japanese Patent Office, International Search Report in International Patent Application No. PCT/JP2019/031649 (Oct. 29, 2019).
Agostoni et al., "Effects of Diet on the Lipid and Fatty Acid Status of Full-term Infants at 4 Months," *J. Am. Coll. Nutr.*, 13(6): 658-664 (1994).
Hayashi et al., "Control Mechanism for Carbon-Chain Length in Polyunsaturated Fatty-Acid Synthases," *Angew. Chem.*, 131(20): 6677-6682 (2019).
Hayashi et al., "Control Mechanism for cis Double-Bond Formation by Polyunsaturated Fatty-Acid Synthases," *Angew. Chem.*, 131(8): 2348-2352 (2019).
Hayashi et al., "Recent Advances in Functional Analysis of Polyunsaturated Fatty Acid Synthases," *Current Opinion in Chemical Biology*, 59: 30-36 (2020).
European Patent Office, Extended European Search Report in European Patent Application No. 19848558.3 (Apr. 8, 2022).
Chen et al., "Functional Analysis of the Dehydratase Domains of the PUFA Synthase from *Emiliania huxleyi* in *Escherichia coli* and *Arabidopsis thaliana*," *Biotechnology for Biofuels & Bioproducts*, 15: 123 (2022).
Gemperlein et al., "Polyunsaturated Fatty Acid Production by *Yarrowia lipolytica* Employing Designed Myxobacterial PUFA Synthases," *Nat. Commun.*, 10: 4055 (2019).
Heath et al., "Roles of the FabA and FabZ β-Hydroxyacyl-Acyl Carrier Protein Dehydratases in *Escherichia coli* Fatty Acid Biosynthesis," *J. Biol. Chem.*, 271(44): 27795-27801 (1996).
Wallis et al., "Polyunsaturated Fatty Acid Synthesis: What Will They Think of Next?," *TRENDS in Biochemical Sciences*, 27(9): 467-473 (2002).
Xie et al., "Distinct Functions of Two FabA-like Dehydratase Domains of Polyunsaturated Fatty Acid Synthase in the Biosynthesis of Very Long-chain Polyunsaturated Fatty Acids," *Environ. Microbiol.*, 22(9): 3772-3783 (2020) [abstract only].
Zirkle et al., "PUFA Synthases," *AOCS Lipid Library*, DOI: 10.21748/lipidlibrary.41528 (2021).
Ujihara et al., "Identification of a Novel Type of Polyunsaturated Fatty Acid Synthase Involved in Arachidonic Acid Biosynthesis," *FEBS Letters*, 588(21): 4032-4036 (2014).
Japan Patent Office, Office Action in Japanese Patent Application No. 2020-535919 (Jun. 20, 2023).
Meesapyodsuk et al., "Biosynthetic Mechanism of Very Long Chain Polyunsaturated Fatty Acids in *Thraustochytrium* sp. 26185," *J. Lipid Res.*, 57(10): 1854-1864 (2016).
China National Intellectual Property Administration, First Office Action in Chinese Patent Application No. 201980053748.9 (Dec. 18, 2023).
Japan Patent Office, Office Action in Japanese Patent Application No. 2020-535919 (Dec. 12, 2023).
China National Intellectual Property Administration, Office Action in Chinese Patent Application No. 201980053748.9 (May 15, 2024).

\* cited by examiner

MICROORGANISM PRODUCING POLYUNSATURATED FATTY ACID AND METHOD FOR PRODUCING POLYUNSATURATED FATTY ACID

CROSS-REFERENCE TO RELATED APPLICATIONS

This patent application is the U.S. national phase of International Patent Application No. PCT/JP2019/031649, filed Aug. 9, 2019, which claims the benefit of Japanese Patent Application No. 2018-151233, filed on Aug. 10, 2018, which are incorporated by reference in their entireties herein.

INCORPORATION-BY-REFERENCE OF MATERIAL ELECTRONICALLY SUBMITTED

Incorporated by reference in its entirety herein is a computer-readable nucleotide/amino acid sequence listing submitted concurrently herewith and identified as follows: 993,916 bytes ASCII (Text) file named "752296Sequence-Listing.txt," created Feb. 5, 2021.

TECHNICAL FIELD

The present invention relates to a microorganism that produces a polyunsaturated fatty acid (PUFA) and a method for producing a PUFA using the microorganism.

BACKGROUND ART

Long-chain fatty acids having a plurality of unsaturated bonds in a molecule such as docosahexaenoic acid (hereinafter, referred to as DHA), eicosapentaenoic acid (hereinafter, referred to as EPA), arachidonic acid (hereinafter, referred to as ARA), and docosapentaenoic acid (hereinafter, referred to as DPA) are referred to as polyunsaturated fatty acids (hereinafter, referred to as PUFAs). PUFAs are known to have various physiological functions such as prevention of arteriosclerosis or hyperlipidemia (NPL 1 and NPL 2).

PUFAs can be classified into ω-3 fatty acids such as DHA and EPA, ω-6 fatty acids such as DPA and ARA, ω-9 fatty acids in which a double bond is first introduced into the 9th carbon, ω-11 fatty acids in which a double bond is first introduced into the $11^{th}$ carbon, and the like, based on the position of a double bond from a methyl end group in a molecule.

As the PUFA biosynthetic pathway, the following two types are known: an aerobic pathway and an anaerobic pathway by a polyunsaturated fatty acid polyketide synthase (hereinafter referred to as PUFA-PKS). The aerobic pathway is a pathway in which a PUFA is synthesized by introducing a double bond using a plurality of desaturases into a long-chain fatty acid such as palmitic acid synthesized using a fatty acid synthase or by elongating a carbon chain using a chain elongase, and is a synthetic pathway which is possessed by many organisms and has been known for many years (NPL 3). On the other hand, the anaerobic pathway by a PUFA-PKS is a pathway for synthesizing a PUFA from malonyl-CoA, and some marine bacteria or eukaryotes of the Labyrinthulomycetes are known to have a pathway for producing DHA or EPA (NPL 4 and NPL 5). Further, as an ARA production system, for example, an ARA production system of *Aureispira marina* is known (NPL 6).

The PUFA-PKS is a complex enzyme (hereinafter, also referred to as protein complex) composed of a plurality of proteins, and in each protein, a plurality of functional domains involved in the PUFA synthesis are present.

The functional domains present in the PUFA-PKS include a β-ketoacyl-acyl carrier protein synthase domain (hereinafter referred to as KS domain) believed to be involved in the condensation of malonyl-ACP and acyl-ACP, an acyl carrier protein domain (hereinafter, referred to as ACP domain) believed to function as a fatty acid synthesis site by binding to an acyl group via a phosphopantetheinyl group through a thioester bond, a ketoreductase domain (hereinafter referred to as KR domain) believed to reduce a carbonyl group generated by condensation, a DH domain believed to form a double bond by dehydration of a hydroxy group generated by the KR domain, a chain elongation factor domain (hereinafter, referred to as CLF domain) believed to be involved in the elongation of a carbon chain, an enoyl reductase domain (hereinafter referred to as ER domain) believed to reduce an obtained double bond, an acyltransferase domain (hereinafter, referred to as AT domain) and a malonyl-CoA:acyltransferase domain (hereinafter, referred to as MAT domain) believed to be involved in the transfer of an acyl group, and a phosphopantetheine transferase domain (hereinafter referred to as PPT domain) believed to activate an ACP domain, and it is considered that a carbon chain of a fatty acid is elongated by the plurality of domains working in cooperation with one another.

As a method for industrially producing ARA, a method of isolating ARA from fungal biomass (PTL 1) is known, however, the method has a problem that unsaturated fatty acids other than the target are by-produced much, and an efficient method for producing ARA has been awaited.

It is known that the PUFA-PKS produces a different type of PUFA depending on its type. For example, a PUFA-PKS derived from *Schizochytrium* sp., *Aurantiochytrium* sp., and *Moritella marina* produces DHA as a main product, a PUFA-PKS derived from *Shewanella oneidensis* and *Photobacterium profundum* produces EPA as a main product, and a PUFA-PKS derived from *Aureispira marina* produces ARA as a main product, and other PUFAs are hardly produced, or even if such other PUFAs are produced, they are produced in a small amount as compared with the main product.

The PUFA-PKS has high product specificity in this manner, however, many studies aiming at the functional analysis of the PUFA-PKS have been conducted so far.

In NPLs 4 and 7, studies in which a PUFA-PKS gene is cloned from bacteria of the genus *Shewanella* or eukaryotes of the Stramenopiles and expressed in a heterogeneous organism to produce a PUFA have been conducted.

NPL 8 discloses that a pfaB gene encoding an AT domain is involved in the type of PUFA to be produced based on a study using a pfaB gene that is a structural gene of a PUFA-PKS derived from *Moritella marina* that produces DHA and a pfaB gene that constitutes a PUFA-PKS derived from *Shewanella pneumatophori* that produces EPA.

NPL 9 discloses that when a DH domain of a PUFA-PKS derived from the genus *Thraustochytrium* is introduced into *E. coli*, the production amount of fatty acids increases, and also the proportion of unsaturated fatty acids increases.

CITATION LIST

Patent Literature

PTL 1: JP-A-2006-219528
PTL 2: WO 2008/144473

Non Patent Literature

NPL 1: Annu. Nutr. Metabol., 1991, 35, 128-131
NPL 2: J. Am. Coll. Nutr., 1994, 13, 658-664
NPL 3: Ann. Rev. Biochem., 1983, 52, 537-579
NPL 4: Science, 2001, 293, 290-293
NPL 5: PLOS One, 2011, 6, e20146
NPL 6: Scientific Reports volume 6, Article number: 35441 (2016), FIG. 5
NPL 7: Plant Physiol. Biochem., 2009, 47, 472-478
NPL 8: FEMS Microbiol. Lett., 2009, 295, 170-176
NPL 9: Appl. Microbiol. Biotechnol., 2018, 847-856

SUMMARY OF INVENTION

Technical Problem

As a conventional PUFA production system using a PUFA-producing microorganism, for example, there is an ARA production system using a microorganism described in NPL 6, but the productivity of ARA by the ARA production system is not sufficient for an industrial level. Further, the method of isolating ARA from fungal biomass as the method described in PTL 1 has a problem that unsaturated fatty acids other than the target are by-produced much.

Therefore, an object of the present invention is to provide a microorganism that efficiently produces a PUFA and a method for producing a PUFA using the microorganism.

Solution to Problem

The present inventors found that by introducing a gene of a PS-DH domain having a higher activity against 3-hydroxyhexanoyl ACP that is a fatty acid substrate in a PUFA production system than a FabA-DH domain in a microorganism capable of producing an ω-3 PUFA, an ω-6 PUFA in which the first double bond is formed at the ω-6 position counted from the terminal carbon atom in the PUFA can be efficiently produced instead of an ω-3 PUFA that is the original target product, and thus completed the present invention.

1. A microorganism capable of producing a PUFA, in which a gene encoding an exogenous PS-DH domain having a higher activity against 3-hydroxyhexanoyl ACP than an endogenous FabA-DH domain has been introduced into a microorganism having a PUFA metabolic pathway.
2. The microorganism according to the above 1, wherein the microorganism having a PUFA metabolic pathway is a microorganism having an ω-3 PUFA metabolic pathway, and the PUFA that can be produced is an ω-6 PUFA.
3. The microorganism according to the above 1 or 2, wherein the microorganism having a PUFA metabolic pathway is a microorganism having an EPA metabolic pathway or DHA metabolic pathway, and the PUFA that can be produced is ARA or DPA.
4. The microorganism according to any one of the above 1 to 3, wherein the microorganism having a PUFA metabolic pathway is derived from the genus *Shewanella*, the genus *Photobacterium*, the genus *Moritella*, the genus *Colwellia*, the genus *Aurantiochytrium*, the genus *Thraustochytrium*, the genus *Ulkenia*, the genus *Parietichytrium*, the genus *Labyrinthula*, the genus *Aplanochytrium*, the genus *Oblongichytrium*, or the genus *Schizochytrium*.
5. A microorganism capable of producing a PUFA, in which genes encoding respective domains described in the following (a) to (j) having a PUFA-PKS activity have been introduced into a microorganism that does not have a PUFA metabolic pathway:
(a) a KS domain;
(b) a MAT domain;
(c) an ACP domain;
(d) a KR domain;
(e) a PS-DH domain;
(f) a CLF domain;
(g) an AT domain;
(h) a FabA-DH domain;
(i) an ER domain; and
(j) a PPT domain, wherein
the PS-DH domain exhibits a higher activity against 3-hydroxyhexanoyl ACP than the FabA-DH domain.
6. The microorganism according to the above 5, which possesses all PUFA synthetic pathway genes possessed by the microorganism capable of producing a PUFA according to any one of the above 1 to 4.
7. The microorganism according to the above 5 or 6, wherein the PUFA that can be produced is an ω-6 PUFA.
8. The microorganism according to any one of the above 5 to 7, wherein the PUFA that can be produced is ARA or DPA.
9. The microorganism according to any one of the above 5 to 8, wherein the microorganism that does not have a PUFA metabolic pathway is a microorganism belonging to the genus *Escherichia*, the genus *Bacillus*, the genus *Corynebacterium*, the genus *Yarrowia*, the genus *Saccharomyces*, the genus *Candida*, or the genus *Pichia*.
10. The microorganism according to any one of the above 1 to 9, wherein the PS-DH domain is a PS-DH domain of AraB derived from *Aureispira marina*.
11. A method for producing a PUFA or a PUFA-containing composition, including culturing the microorganism according to any one of the above 1 to 10 in a culture medium so as to produce and accumulate a PUFA or a PUFA-containing composition in a culture, and collecting the PUFA or the PUFA-containing composition from the culture.
12. A method for producing a PUFA or a PUFA-containing composition using the following microorganism (I) or (II) capable of producing a PUFA:
(I) a microorganism capable of producing a PUFA, in which a gene encoding a PS-DH domain having a higher activity against 3-hydroxyhexanoyl ACP than an endogenous FabA-DH domain has been introduced into a microorganism having a PUFA metabolic pathway; or
(II) a microorganism capable of producing a PUFA, in which genes encoding respective domains described in the following (a) to (j) having a PUFA-PKS activity have been introduced into a microorganism that does not have a PUFA metabolic pathway:
(a) a KS domain;
(b) a MAT domain;
(c) an ACP domain;
(d) a KR domain;
(e) a PS-DH domain;
(f) a CLF domain;
(g) an AT domain;
(h) a FabA-DH domain;
(i) an ER domain; and (j) a PPT domain, wherein
the PS-DH domain exhibits a higher activity against 3-hydroxyhexanoyl ACP than the FabA-DH domain.

Advantageous Effects of Invention

The microorganism of the present invention is configured by introducing a gene of a PS-DH domain having a higher activity against 3-hydroxyhexanoyl ACP that is a fatty acid substrate than a FabA-DH domain into a microorganism capable of producing a PUFA, so that the reactivity of the PS-DH domain with 3-hydroxyhexanoyl ACP is relatively high as compared with that of the FabA-DH domain in the microorganism, and a target PUFA or PUFA-containing composition can be efficiently produced. According to the production method of the present invention, a PUFA can be produced at low cost with high efficiency, and thus the method can be applied to the production of the PUFA at an industrial level.

DESCRIPTION OF EMBODIMENTS

Figure 1:
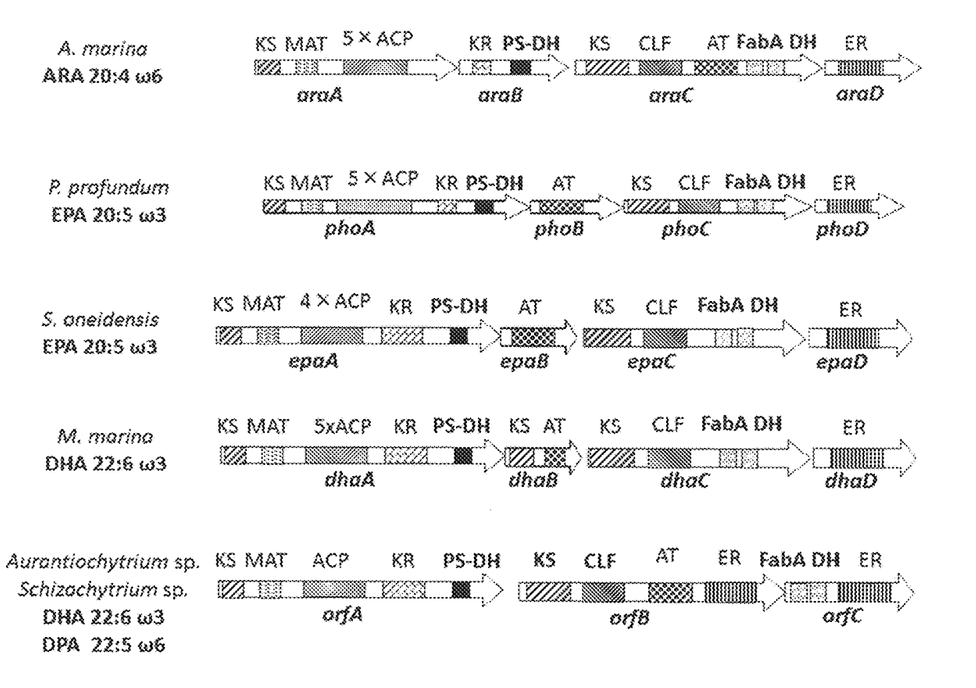
The FIGURE shows schematic diagrams of proteins constituting a PUFA-PKS and domain structures thereof in various microorganisms.

In the present invention, the "polyunsaturated fatty acid (PUFA)" refers to a long-chain fatty acid having a carbon chain length of 18 or more and having 2 or more unsaturated bonds. Further, the "domain" as used herein refers to a part composed of a continuous amino acid sequence in a protein, and is a region having a specific biological activity or function in the protein.

In the present invention, the "PUFA-PKS" has the same meaning as a PUFA synthase. The PUPA synthase is a group of enzymes that synthesize a specific long-chain unsaturated fatty acid using malonyl-CoA or the like as a carbon source, and refers to one containing the respective domains of KS, MAT, ACP, KR, PS-DH, CLF, AT, FabA-DH, ER, and PPTase (ACOS Lipid Library: PUFA synthase; Science, 2001, 293, 290-293; PLoS One, 2011, 6, e20146, etc.).

The KS domain is a domain included in a protein constituting a protein complex having a PUFA-PKS activity, and refers to a domain involved in the condensation of malonyl ACP and acyl ACP.

The MAT domain and the AT domain are domains included in a protein constituting a protein complex having a PUFA-PKS activity, and refer to domains involved in the transfer of an acyl group.

The ACP domain is a domain included in a protein constituting a protein complex having a PUFA-PKS activity, and refers to a domain that functions as a fatty acid synthesis site by binding to an acyl group via a phosphopantetheinyl group through a thioester bond, and is essential for a PUFA-PKS activity.

The KR domain is a domain included in a protein constituting a protein complex having a PUFA-PKS activity, and refers to a domain involved in the reduction of a ketone group generated by condensation.

The PS-DH domain and the FabA-DH domain, which are DH domains, are domains included in a protein constituting a protein complex having a PUFA-PKS activity, and refers to domains involved in the dehydration of a hydroxy group generated by the reduction of a ketone group.

The CLF domain is a domain included in a protein constituting a protein complex having a PUFA-PKS activity, and refers to a domain involved in the elongation of a carbon chain.

The ER domain is a domain included in a protein constituting a protein complex having a PUFA-PKS activity.

The PPTase is an enzyme that constitutes a protein complex having a PUFA-PKS activity, and refers to an enzyme involved in the activation of an ACP domain.

The expression "in cooperation with one another" as used herein means that when a certain protein is allowed to coexist with another protein, the proteins carry out a specific reaction together. In particular, in this description, the expression refers to that when a plurality of domains necessary for a PUFA-PKS activity are allowed to coexist, the domain exhibits the PUFA-PKS activity together with the other domains.

The "exogenous" as used herein refers to a substance that is not endogenous but is derived from a heterogeneous substance, and is used for meaning that a gene based on the present invention is introduced into a host organism when the host organism before transformation does not have a gene to be introduced according to the present invention, when a protein encoded by the gene is not substantially expressed, and when an amino acid sequence of the protein is encoded by a different gene, but the activity of an endogenous protein after transformation is not exerted.

The "host organism" as used herein refers to an original organism to be subjected to genetic modification, transformation, or the like. When the original organism to be subjected to transformation by gene transfer is a microorganism, it is also referred to as a parent strain or a host strain.

[Microorganism]

As the microorganism of the present invention, the following microorganism (1) or (2) is exemplified.
(1) a microorganism capable of producing a PUFA, in which a gene encoding an exogenous PS-DH domain having a higher activity against 3-hydroxyhexanoyl ACP than a FabA-DH domain has been introduced into a microorganism having a PUFA metabolic pathway
(2) a microorganism capable of producing a PUFA, in which genes encoding respective domains of KS, MAT, ACP, KR, PS-DH, CLF, AT, FabA-DH, ER, and PPTase having a PUFA-PKS activity have been introduced into a microorganism that does not have a PUFA metabolic pathway, and the PS-DH domain exhibits a higher activity against 3-hydroxyhexanoyl ACP than the FabA-DH domain A microorganism having a PUFA metabolic pathway refers to a microorganism having an ability to produce a PUFA by nature. Examples of the microorganism having a PUFA metabolic pathway include the genus *Shewanella*, the genus *Photobacterium*, the genus *Moritella*, the genus *Colwellia*, the genus *Aurantiochytrium*, the genus *Thraustochytrium*, the genus *Ulkenia*, the genus *Parietichytrium*, the genus *Labyrinthula*, the genus *Aplanochytrium*, the genus *Oblongichytrium*, and the genus *Schizochytrium*.

As the microorganism having a PUFA metabolic pathway, a microorganism having an ω-3 PUFA metabolic pathway is preferred, and examples thereof include a microorganism having a DHA metabolic pathway and a microorganism having an EPA metabolic pathway.

Examples of the microorganism having a DHA metabolic pathway include microorganisms of the genus *Moritella*, the genus *Colwellia*, the genus *Aurantiochytrium*, the genus *Thraustochytrium*, and the genus *Schizochytrium*. Preferred examples thereof include *Moritella marina*, *Colwellia psy-*

*chrerythraea, Aurantiochytrium limacinum, Thraustochytrium aureum*, and the like, however, the microorganism is not limited thereto as long as the microorganism has a DHA metabolic pathway.

As the microorganism having a DHA metabolic pathway, a microorganism belonging to the genus *Aurantiochytrium* is preferred, and for example, *Aurantiochytrium* sp. OH4 strain (accession number FERM BP-11524) and the like are exemplified, and further, a microorganism that is a mutant thereof and has an ability to produce DHA may be used.

The *Aurantiochytrium* sp. OH4 strain was deposited in the National Institute of Technology and Evaluation (NITE), Patent Microorganisms Depositary Center, located at Central 6, 1-1, Higashi, Tsukuba, Ibaraki, Japan (zip code: 305-8566). The date of receipt (date of deposit) is January 11, Heisei 25 (AD 2013), and the accession number is FERM BP-11524.

Examples of the microorganism having an EPA metabolic pathway include microorganisms of the genus *Shewanella*, the genus *Photobacterium*, and the genus *Vibrio*. Preferred examples thereof include *Shewanella oneidensis, Shewanella livingstonensis, Shewanella baltica, Shewanella pealeana, Photobacterium profundum*, and the like, however, the microorganism is not limited thereto as long as the microorganism has an EPA metabolic pathway.

The microorganism that does not have a PUFA metabolic pathway refers to a microorganism that does not have an ability to produce a PUFA by nature. Examples of the microorganism that does not have a PUFA metabolic pathway include a bacterium, a microalga, a fungus, a protist, and a protozoan.

Examples of the bacterium include microorganisms belonging to a genus selected from the group consisting of the genus *Escherichia*, the genus *Serratia*, the genus *Bacillus*, the genus *Brevibacterium*, the genus *Corynebacterium*, the genus *Microbacterium*, the genus *Pseudomonas*, and the genus *Aureispira*. Among these, a microorganism selected from the group consisting of *Escherichia coli* XL1-Blue, *Escherichia coli* XL2-Blue, *Escherichia coli* DH1, *Escherichia coli* MC1000, *Escherichia coli* KY3276, *Escherichia coli* W1485, *Escherichia coli* JM109, *Escherichia coli* HB101, *Escherichia coli* No. 49, *Escherichia coli* W3110, *Escherichia coli* NY49, *Escherichia coli* BL21 codon plus (manufactured by Stratagene Corporation), *Serratia ficaria, Serratia fonticola, Serratia liquefaciens, Serratia marcescens, Bacillus subtilis, Bacillus amyloliquefaciens, Brevibacterium immariophilum* ATCC 14068, *Brevibacterium saccharolyticum* ATCC 14066, *Corynebacterium ammoniagenes, Corynebacterium glutamicum* ATCC 13032, *Corynebacterium glutamicum* ATCC 14067, *Corynebacterium glutamicum* ATCC 13869, *Corynebacterium acetoacidophilum* ATCC 13870, *Microbacterium ammoniaphilum* ATCC 15354, *Pseudomonas* sp. D-0110, and *Aureispira marina* JCM 23201 is preferred.

Examples of the microalga include the class Euglenophyceae (for example, the genus *Euglena* and the genus *Peranema*), the class Chrysophyceae (for example, the genus Ochromonas), the class Dinobryaceae (for example, the genus *Dinobryon*, the genus *Platychrysis*, and the genus *Chrysochromulina*), the class Dinophyceae (for example, the genus *Cryptecodinium*, the genus *Gymnodinium*, the genus *Peridinium*, the genus *Ceratium*, the genus *Gyrodinium*, and the genus *Oxyrrhis*), the class Cryptophyceae (for example, the genus *Cryptomonas* and the genus *Rhodomonas*), the class Xanthophyceae (for example, the genus *Olisthodiscus*) (and including a variety of algae to pass into an amoeboid phase as in the case of a zoospore or a gamete of Rhizochloridaceae and *Aphanochaete pascheri, Bumilleria stigeoclonium* and *Vaucheria geminata*), the class Eustigmatophyceae, and the class Prymnesiopyceae (including, for example, the genus *Prymnesium* and the genus *Diacronema*).

Preferred species in such genera are not particularly limited, however, *Nannochloropsis oculata, Cryptheco-dinium cohnii*, and *Euglena gracilis* are exemplified.

Examples of the fungus include yeast including the genus *Saccharomyces* (for example, *Saccharomyces cerevisiae* and *Saccharomyces carlsbergensis*), or other yeast such as the genus *Yarrowia*, the genus *Candida*, the genus *Pichia*, the genus *Kluyveromyces*, or other fungi, for example, filamentous fungi such as the genus *Aspergillus*, the genus *Neurospora*, and the genus *Penicillium*, and the like.

The microorganism (2) is preferably a microorganism, in which all the PUFA synthetic pathway genes possessed by the microorganism (1) have been introduced, that is, a microorganism having all the PUFA synthetic pathway genes possessed by the microorganism (1).

In the present invention, the "activity against 3-hydroxyhexanoyl ACP" is an activity that preferentially acts against 3-hydroxyhexanoyl ACP, and more specifically refers to reactivity with (affinity for) 3-hydroxyhexanoyl ACP. The activity against 3-hydroxyhexanoyl ACP can be measured by a method of evaluating a reverse reaction of a dehydratase (hydroxylation reaction).

As the method, for example, under the condition that crotonyl ACP or 2-trans-hexenoyl ACP to serve as a substrate is prepared, a product obtained by adding a protein containing a FabA-DH domain or a PS-DH domain is analyzed by HPLC, and the amounts of the products are compared by comparing the heights of peaks (the product when using crotonyl ACP as the substrate: 3-hydroxybutyryl-ACP, the product when using 2-trans-hexenoyl ACP as the substrate: 3-hydroxy-hexanoyl-ACP). Then, when the amount of the product in the case of using crotonyl ACP as the substrate is smaller than the amount of the product in the case of using 2-trans-hexenoyl ACP as the substrate, it is determined that the activity of the PS-DH domain against 3-hydroxyhexanoyl ACP is higher than the activity of the FabA-DH domain.

In the present invention, "the PS-DH domain exhibits a higher activity against 3-hydroxyhexanoyl ACP than the FabA-DH domain" specifically means, for example, that with respect to the heights of the HPLC peaks obtained by a reaction under the following reaction conditions, the height of the HPLC peak of the product when using 2-trans-hexenoyl ACP as the substrate is preferably 1.5 times or more, more preferably 2 times or more, further more preferably 5 times or more the height of the HPLC peak of the product when using crotonyl ACP as the substrate.

(Reaction Conditions)

To a system in which Tris-HCl (80 mM), NaCl (80 mM), $MgCl_2$ (25 mM), ACP to serve as a substrate (100 µM), Sfp (20 µM), and acyl-CoA (300 µM) are mixed and reacted at 20° C. for 10 minutes, a protein containing a PS-DH domain and a FabA-DH domain is added at 1 µM or 5 µM, and reacted at 20° C. Samples are collected after 1, 5, 10, 30, and 60 minutes from the start of the reaction, and subjected to an LC/MS analysis, and then, the heights of the HPLC peaks are analyzed. The "Sfp" means 4'-phosphopantetheinyl transferase derived from *Bacillus subtilis*.

Specifically, for example, in the case of the microorganism (1) described above, the activity of an endogenous PS-DH domain against 3-hydroxyhexanoyl ACP in the microorganism having a PUFA metabolic pathway is equal to or less than that of an endogenous FabA-DH domain, however, by introducing an exogenous gene encoding a PS-DH domain having the activity higher than the endogenous FabA-DH domain into the microorganism, the microorganism becomes such that the reactivity of the PS-DH domain with 3-hydroxyhexanoyl ACP in the microorganism is relatively high as compared with that of the FabA-DH domain.

Further, for example, in the case of the microorganism (2) described above, among the respective domains having a PUFA-PKS activity expressed by introducing the genes into a microorganism that does not have a PUFA metabolic pathway, the PS-DH domain has a higher activity against 3-hydroxyhexanoyl ACP than the FabA-DH domain, and therefore, the microorganism becomes such that the reactivity of the PS-DH domain with 3-hydroxyhexanoyl ACP in the microorganism is relatively high as compared with that of the FabA-DH domain.

Since the reactivity of the PS-DH domain with 3-hydroxyhexanoyl ACP in the microorganism is relatively high as compared with that of the FabA-DH domain, in the PUFA metabolic pathway of the microorganism, the PS-DH domain preferentially reacts with 3-hydroxyhexanoyl ACP than the FabA-DH domain, so that a PUFA is produced through a PUFA biosynthetic pathway in which the PS-DH domain functions.

As a PUFA biosynthetic pathway in which the FabA-DH domain functions and a PUFA biosynthetic pathway in which the PS-DH domain functions, an ω-3 PUFA biosynthetic pathway in which the FabA-DH domain functions and an ω-6 PUFA biosynthetic pathway in which the PS-DH domain functions are exemplified.

When the position of the double bond counted from the terminal carbon atom in the PUFA obtained in the PUFA biosynthetic pathway in which the FabA-DH domain functions is denoted by ω-(α) position (for example, ω-3 position), in the PUFA obtained in the PUFA biosynthetic pathway in which the PS-DH domain functions, the position of the double bond counted from the terminal carbon atom becomes ω-(α+3) position (for example, ω-6 position).

Therefore, for example, by introducing a gene encoding an exogenous PS-DH domain having a higher activity against 3-hydroxyhexanoyl ACP than an endogenous FabA-DH domain into a microorganism having a metabolic pathway of an ω-3 PUFA, in which the endogenous FabA-DH domain has a higher activity against 3-hydroxyhexanoyl ACP than the PS-DH domain, the reactivity of the PS-DH domain with 3-hydroxyhexanoyl ACP in the microorganism becomes relatively high as compared with that of the FabA-DH domain. As a result, the PS-DH domain more preferentially acts on 3-hydroxyhexanoyl ACP than the FabA-DH domain, so that the microorganism becomes such that it can produce an ω-6 PUFA as a final product.

In the present invention, as the PS-DH domain, a PS-DH domain on AraB derived from *Aureispira marina* [a protein having an amino acid sequence represented by SEQ ID NO: 2 (encoded by the base sequence represented by SEQ ID NO: 136)], or a PS-DH domain on pfaB derived from *Psychroflexus torquis* [a protein having the amino acid sequence represented by SEQ ID NO: 137 (encoded by the base sequence represented by SEQ ID NO: 139)] is exemplified, and the PS-DH domain on araB derived from *Aureispira marina* is preferred. These sequences are known and can be used as appropriate. Further, by utilizing a known sequence, a gene encoding a PS-DH domain having a higher activity against 3-hydroxyhexanoyl ACP than the endogenous FabA-DH domain can be obtained.

More specifically, as the PS-DH domain to be used in the present invention, preferably, the following proteins are exemplified.

[1] A protein having the amino acid sequence represented by SEQ ID NO: 2 or SEQ ID NO: 137

[2] A mutant protein that is composed of an amino acid sequence in which in the amino acid sequence represented by SEQ ID NO: 2 or SEQ ID NO: 137, 1 to 20, preferably 1 to 10, and most preferably 1 to 5 amino acids have been deleted, substituted, or added, and that has an activity against 3-hydroxyhexanoyl ACP

[3] A homologous protein that has at least 95% or more, preferably 97% or more, more preferably 98% or more, and most preferably 99% or more identity with the amino acid sequence represented by SEQ ID NO: 2 or SEQ ID NO: 137, and that has an activity against 3-hydroxyhexanoyl ACP The gene encoding the PS-DH domain may be introduced into a microorganism by introducing a gene encoding a protein having the PS-DH domain into the microorganism. Examples of the protein having the PS-DH domain include AraB derived from *Aureispira marina* [a protein having the amino acid sequence represented by SEQ ID NO: 58 (encoded by the base sequence represented by SEQ ID NO: 57)], and PfaB derived from *Psychroflexus torquis* [a protein having the amino acid sequence represented by SEQ ID NO: 138 (encoded by the base sequence represented by SEQ ID NO: 140)].

More specifically, as the protein having the PS-DH domain to be used in the present invention, preferably, the following proteins are exemplified.

[4] A protein having the amino acid sequence represented by SEQ ID NO: 58 or SEQ ID NO: 138

[5] A mutant protein that is composed of an amino acid sequence in which in the amino acid sequence represented by SEQ ID NO: 58 or SEQ ID NO: 138, 1 to 20, preferably 1 to 10, and most preferably 1 to 5 amino acids have been deleted, substituted, or added, and that has an activity against 3-hydroxyhexanoyl ACP

[6] A homologous protein that has at least 95% or more, preferably 97% or more, more preferably 98% or more, and most preferably 99% or more identity with the amino acid sequence represented by SEQ ID NO: 58 or SEQ ID NO: 138, and that has an activity against 3-hydroxyhexanoyl ACP The protein having the amino acid sequence represented by SEQ ID NO: 58 is a protein composed of 801 amino acid residues, and has the PS-DH domain at 531-790 residues from the N-terminal side.

The mutant protein refers to a protein obtained by artificially deleting or substituting an amino acid residue in the original protein or adding an amino acid residue into the protein. In the mutant protein described above, the deletion, substitution, insertion, or addition of amino acids may be deletion, substitution, or addition of 1 to 20, preferably 1 to 10, and most preferably 1 to 5 amino acids at arbitrary positions in the same sequence.

The amino acid to be deleted, substituted, or added may be either a natural type or an unnatural type. Examples of the natural type amino acid include L-alanine, L-asparagine, L-aspartic acid, L-glutamine, L-glutamic acid, glycine, L-histidine, L-isoleucine, L-leucine, L-lysine, L-arginine, L-methionine, L-phenylalanine, L-proline, L-serine, L-threonine, L-tryptophan, L-tyrosine, L-valine, and L-cysteine.

Hereinafter, examples of mutually substitutable amino acids are shown. Amino acids included in the same group can be mutually substituted.

group A: leucine, isoleucine, norleucine, valine, norvaline, alanine, 2-aminobutanoic acid, methionine, O-methylserine, t-butyl glycine, t-butyl alanine, and cyclohexylalanine group B: aspartic acid, glutamic acid, isoaspartic acid, isoglutamic acid, 2-aminoadipic acid, and 2-aminosuberic acid group C: asparagine and glutamine group D: lysine, arginine, ornithine, 2,4-diaminobutanoic acid, and 2,3-diaminopropionic acid group E: proline, 3-hydroxyproline, and 4-hydroxyproline group F: serine, threonine, and homoserine group G: phenylalanine and tyrosine The homologous protein refers to a protein in which a gene encoding the protein is considered to have the same evolutionary origin as a gene encoding the original protein because of similarity in structure and function to the original protein, and which is possessed by an organism present in nature.

The identity of amino acid sequences or base sequences can be determined using the algorithm BLAST [Pro. NAT domain 1. Acad. Sci. USA, 90, 5873 (1993)] or FASTA [Methods Enzymol., 183, 63 (1990)] by Karlin and Altschul. Based on the algorithm BLAST, programs called BLASTN and BLASTX have been developed [J. Mol. Biol., 215, 403 (1990)]. When analyzing a base sequence by BLASTN based on BLAST, parameters are set to, for example, as follows: score=100 and wordlength=12. Further, when analyzing an amino acid sequence by BLASTX based on BLAST, parameters are set to, for example, as follows: score=50 and wordlength=3. When using BLAST and Gapped BLAST programs, the default parameters of each program are used. Specific methods of these analysis methods are known.

The gene encoding the PS-DH domain to be used in the present invention is not limited as long as it is a gene encoding a protein having an activity against 3-hydroxyhexanoyl ACP, but preferably a gene having any one of the following DNAs is exemplified.

[7] A DNA encoding any one of the proteins described in the above [1] to [3]

[8] A DNA containing the base sequence represented by SEQ ID NO: 136 or SEQ ID NO: 139

[9] A DNA that hybridizes with a DNA composed of a base sequence complementary to the DNA described in the above [7] or [8] under stringent conditions, and that encodes a homologous protein having an activity against 3-hydroxyhexanoyl ACP.

[10] A DNA that has at least 95% or more, preferably 97% or more, more preferably 98% or more, and most preferably 99% or more identity with the base sequence of the DNA described in the above [7] or [8], and that encodes a homologous protein having an activity against 3-hydroxyhexanoyl ACP Further, as the gene encoding the protein having the PS-DH domain, preferably, a gene having any one of the following DNAs is exemplified.

[11] A DNA encoding any one of the proteins described in the above [4] to [6]

[12] A DNA containing the base sequence represented by SEQ ID NO: 57 or SEQ ID NO: 140

[13] A DNA that hybridizes with a DNA composed of a base sequence complementary to the base sequence of the DNA described in the above [11] or [12] under stringent conditions, and that encodes a homologous protein having an activity against 3-hydroxyhexanoyl ACP.

[14] A DNA that has at least 95% or more, preferably 97% or more, more preferably 98% or more, and most preferably 99% or more identity with the base sequence of the DNA described in the above [11] or [12], and that encodes a homologous protein having an activity against 3-hydroxyhexanoyl ACP The "hybridize" refers to that a DNA having a specific base sequence or a part of the DNA complementarily forms a complex with another DNA. Therefore, the base sequence of a DNA having a specific base sequence or a part of the DNA is useful as a probe for a Northern or Southern blot analysis or may be a DNA having a length that can be used as an oligonucleotide primer for a PCR analysis. As the DNA to be used as a probe, a DNA having at least 100 or more bases, preferably 200 or more bases, and more preferably 500 or more bases can be exemplified. As the DNA to be used as a primer, a DNA having at least 10 or more bases, preferably 15 or more bases can be exemplified.

A method for a DNA hybridization experiment is well known and described in, for example, Molecular Cloning 2nd and 3rd Edition (2001), Methods for GenER domain al and Molecular Bacteriology, ASM Press (1994), Immunology methods manual, Academic Press (Molecular). In addition, the experiment can be carried out by determining the conditions for the hybridization according to a number of other standard textbooks.

Further, a DNA that hybridizes under stringent conditions can be obtained also according to the instructions attached to a commercially available hybridization kit. As the commercially available hybridization kit, for example, a random primed DNA labeling kit (manufactured by Roche Diagnostics GmbH) with which a probe is prepared by a random prime method and hybridization is carried out under stringent conditions, and the like can be exemplified.

As the stringent conditions, for example, conditions in which a filter having a DNA immobilized thereon and a probe DNA are incubated overnight at 42° C. in a solution containing 50% formamide, 5×SSC (750 mM sodium chloride and 75 mM sodium citrate), 50 mM sodium phosphate (pH 7.6), 5×Denhardt's solution, 10% dextran sulfate, and 20 µg/L denatured salmon sperm DNA, followed by washing the filter in a 0.2×SSC solution at about 65° C. can be exemplified.

The various conditions described above can also be set by adding or changing a blocking reagent used for suppressing the background of the hybridization experiment. The addition of the blocking reagent described above may involve changing the hybridization conditions so as to adapt the conditions.

As the DNA that can hybridize under the above-mentioned stringent conditions, for example, a DNA composed of a base sequence having at least 95% or more, preferably 97% or more, more preferably 98% or more, and most preferably 99% or more identity with the base sequence of the target DNA when performing calculation based on the above-mentioned parameters using the programs such as BLAST and FASTA described above can be exemplified.

Examples of the respective domains having a PUFA-PKS activity to be introduced in the microorganism (2) include a KS domain, a MAT domain, an ACP domain, a KR domain, a CLF domain, an AT domain, a FabA-DH domain which is an a DH domain, an ER domain, and a PPT domain. The respective domains are not limited as long as they cooperate with one another to produce a PUFA using acetyl-CoA as a starting substrate, and for example, respective domains included in a known PUFA-PKS can be exemplified.

The PUFA-PKS activity exhibited by the respective domains having a PUFA-PKS activity introduced into the microorganism (2) in cooperation with one another can be confirmed by creating a microorganism transformed with the genes encoding the respective domains of a PUFA-PKS, culturing the microorganism in a culture medium so as to produce and accumulate a PUFA in a culture, and measuring the PUFA accumulated in the culture by gas chromatography.

In the present description, as the "known PUFA-PKS", preferably a PUFA-PKS originally possessed by a microorganism belonging to a genus selected from the group consisting of the genus *Shewanella*, the genus *Colwellia*, the genus *Desulfatibacillum*, the genus *Psychroflexus*, the genus *Schizochytrium*, the genus *Nostoc*, the genus *Microcystis*, the genus *Saccharopolyspora*, the genus *Geobacter*, the genus *Planctomyces*, the genus *Desulfococcus*, the genus *Sorangium*, the genus *Renibacterium*, the genus *Chitinophaga*, the genus *Gloeobacter*, the genus *Azotobacter*, the genus *Rhodococcus*, the genus *Solibacter*, the genus *Desulfobacterium*, the genus *Clostridium*, the genus *Thraustochytrium*, the genus *Ulkenia*, the genus *Japonochytrium*, the genus *Aurantiochytrium*, and the genus *Moritella*, more preferably a PUFA-PKS originally possessed by a microorganism selected from the group consisting of *Shewanella pealeana* ATCC 700345, *Shewanella oneidensis* MR-1, *Colwellia psychrerythraea* 34H, *Desulfatibacillum alkenivorans* AK-01, *Psychroflexus torquis* ATCC 700755, *Schizochytrium* sp. ATCC 20888, *Nostoc punctiforme* PCC 73102, *Microcystis aeruginosa* NIES-843, *Saccharopolyspora erythraea* NRRL 2338, *Geobacter bemidjiensis* Bem, *Planctomyces limnophilus* DSM 3776, *Desulfococcus oleovorans* Hxd3, *Sorangium cellulosum* 'Soce 56', *Renibacterium salmoninarum* ATCC 33209, *Chitinophaga pinensis* DSM 2588, *Gloeobacter violaceus* PCC 7421, *Azotobacter vinelandii* DJ, *Rhodococcus erythropolis* PR4, Candidatus *Solibacter usitatus* Ellin 6076, *Desulfobacterium autotrophicum* HRM2, *Clostridium thermocellum* ATCC 27405, *Schizochytrium minutum*, *Schizochytrium* sp. S31 ATCC 20888, *Schizochytrium* sp. S8 ATCC 20889, *Schizochytrium* sp. LC-RM ATCC 18915, *Schizochytrium* sp. SR21, *Schizochytrium aggregatum* ATCC 28209, *Schizochytrium limacinum* IFO 32693, *Thraustochytrium* sp. 23B ATCC 20891, *Thraustochytrium striatum* ATCC 24473, *Thraustochytrium aureum* ATCC 34304, *Thraustochytrium roseum* ATCC 28210, *Ulkenia* sp. BP-5601, and *Japonochytrium* sp. L1 ATCC 28207, and most preferably, a PUFA-PKS originally possessed by a microorganism selected from the group consisting of *Shewanella pealeana* ATCC 700345, *Shewanella oneidensis* MR-1, *Colwellia psychrerythraea* 34H, *Moritella marina* MP-1, and *Schizochytrium* sp. ATCC 20888 can be exemplified [FEMS Microbiol. Lett. (2009), Vol. 295, pp. 170-176; PLoS ONE (2011), Vol. 6(5), art. no. e20146].

In Table 1, the amino acid sequences of the respective domains included in proteins constituting a PUFA-PKS used in the below-mentioned Examples, and examples of the amino acid sequences of the respective domains included in proteins constituting a known PUFA-PKS are shown.

TABLE 1

| Microorganism | Protein | Domain | Amino acid SEQ ID NO |
|---|---|---|---|
| *Aureispira marina* (JCM 23201) | AraB | KR | 1 |
|  |  | DH | 2 |
|  | AraC | KS | 3 |
|  |  | CLF | 4 |
|  |  | AT | 5 |
|  |  | DH (1) | 6 |
|  |  | DH (2) | 7 |
|  | AraD | ER | 8 |
| *Photobacterium profundum* SS99 (ATCC BAA-1252) | PhoA | KS | 9 |
|  |  | MAT | 10 |
|  |  | ACP | 11 |
|  |  | KR | 12 |
|  |  | DH | 13 |
|  | PhoB | AT | 14 |
|  | PhoC | KS | 15 |
|  |  | CLF | 16 |
|  |  | DH (1) | 17 |
|  |  | DH (2) | 18 |
|  | PhoD | ER | 19 |
| *Shewanella oneidensis* MR-1 (ATCC BAA-1096) | EpaA | KS | 20 |
|  |  | MAT | 21 |
|  |  | ACP | 22 |
|  |  | KR | 23 |
|  |  | DH | 24 |
|  | EpaB | AT | 25 |
|  | EpaC | KS | 26 |
|  |  | CLF | 27 |
|  |  | DH (1) | 28 |
|  |  | DH (2) | 29 |
|  | EpaD | ER | 30 |
| *Schizochytrium* sp. (ATCC 20888) | OrfA | KS | 31 |
|  |  | MAT | 32 |
|  |  | ACP | 33 |
|  |  | KR | 34 |
|  |  | DH | 35 |
|  | OrfB | KS | 36 |
|  |  | CLF | 37 |
|  |  | AT | 38 |
|  |  | ER | 39 |
|  | OrfC | DH (1) | 40 |
|  |  | DH (2) | 41 |
|  |  | ER | 42 |
| *Aurantiochytrium* sp. OH4 (FERM BP-11524) | OrfA | KS | 43 |
|  |  | MAT | 44 |
|  |  | ACP | 45 |
|  |  | KR | 46 |
|  |  | DH | 47 |
|  | OrfB | KS | 48 |
|  |  | CLF | 49 |
|  |  | AT | 50 |
|  |  | ER | 51 |
|  | OrfC | DH (1) | 52 |
|  |  | DH (2) | 53 |
|  |  | ER | 54 |

A protein complex having a PUFA-PKS activity and proteins constituting the protein complex may be physically bound to each other or separated from each other as long as the protein complex has a PUFA-PKS activity.

The protein constituting the protein complex having a PUFA-PKS activity may be any of a wild-type protein, a homologous protein, and a mutant protein as long as it is a protein having a PUFA-PKS activity in cooperation with another protein.

The FIGURE shows proteins constituting a PUFA-PKS derived from various microorganisms and their domain structures. Further, in Table 2, examples of the amino acid sequences of the proteins constituting a PUFA-PKS and the base sequences in various microorganisms are shown.

TABLE 2

| Microorganism | Protein | Base sequence SEQ ID NO | Amino acid SEQ ID NO |
|---|---|---|---|
| *Aureispira marina* (JCM 23201) | AraA | 55 | 56 |
| | AraB | 57 | 58 |
| | AraC | 59 | 60 |
| | AraD | 61 | 62 |
| | AraE | 63 | 64 |
| *Photobacterium profundum* SS9 (ATCC BAA-1252) | PhoA | 65 | 66 |
| | PhoB | 67 | 68 |
| | PhoC | 69 | 70 |
| | PhoD | 71 | 72 |
| *Shewanella oneidensis* MR-1 (ATCC BAA-1096) | EpaA | 73 | 74 |
| | EpaB | 75 | 76 |
| | EpaC | 77 | 78 |
| | EpaD | 79 | 80 |
| | EpaE | 81 | 82 |
| *Schizochytrium* sp. (ATCC 20888) | OrfA | 83 | 84 |
| | OrfB | 85 | 86 |
| | OrfC | 87 | 88 |
| *Aurantiochytrium* sp. OH4 (FERM BP-11524) | OrfB | 89 | 90 |
| | OrfC | 91 | 92 |
| *Anabaena* (Nostoc) sp. PCC 7120 | HetI | 93 | 94 |
| *Moritella marina* MP-1 (ATCC 15381) | DhaA | 95 | 96 |
| | DhaB | 97 | 98 |
| | DhaC | 99 | 100 |
| | DhaD | 101 | 102 |
| | DhaE | 103 | 104 |
| *Escherichia coli* W3110 | FadE | 105 | 106 |

A base sequence encoding a protein constituting a protein complex having a PUFA-PKS activity is not particularly limited as long as it is a base sequence encoding a protein having a PUFA-PKS activity in cooperation with another protein, and for example, a base sequence shown in Table 2, and a base sequence that has at least 95% or more, preferably 97% or more, more preferably 98% or more, and most preferably 99% or more identity with the base sequence, and that encodes a protein that is encoded by the base sequence and has a PUFA-PKS activity in cooperation with another protein are exemplified.

A combination of the proteins constituting the protein complex having a PUFA-PKS activity in cooperation with one another is not particularly limited as long as the protein complex has a PUFA-PKS activity and the PS-DH domain exhibits a higher activity against 3-hydroxyhexanoyl ACP than the FabA-DH domain, and for example, the following combinations are exemplified. In the following (i) to (iv), the amino acid sequences of the respective proteins are as shown in Table 2.

(i) PhoA, PhoB, PhoC, PhoD, EpaE, AraB
(ii) EpaA, PhoB, PhoC, PhoD, EpaE, AraB
(iii) EpaA, AraB, AraC, AraD, EpaE
(iv) PhoA, AraB, AraC, AraD, EpaE

[Method for Creating Microorganism]

The microorganism (1) is obtained by introducing a gene encoding an exogenous PS-DH domain having a higher activity against 3-hydroxyhexanoyl ACP than an endogenous FabA-DH domain or a gene encoding a protein having the PS-DH domain using a microorganism having a PUFA metabolic pathway as a host organism so as to transform the microorganism.

The microorganism (2) is obtained by introducing genes encoding respective domains having a PUFA-PKS activity or genes encoding proteins constituting a PUFA-PKS using a microorganism that does not have a PUFA metabolic pathway as a host organism so that among the respective domains having a PUFA-PKS activity expressed in the host organism by the introduction of the genes, the PS-DH domain is made to exhibit a higher activity against 3-hydroxyhexanoyl ACP than the FabA-DH domain.

The introduction of a gene encoding the PS-DH domain includes a case where the gene is present in the host cell as an autonomously replicable plasmid, a case where a gene to be substituted in the host cell is substituted with a corresponding exogenous gene, and a case where a gene encoding an exogenous PS-DH domain is integrated into a region different from the gene encoding the PUFA-PKS in a chromosomal DNA in the host cell. In the present invention, when the gene is introduced, it is preferred to optimize the sequence with reference to the codon usage frequency of a microorganism to be used as the host.

Further, the genes encoding the respective domains constituting the PUFA-PKS or the genes encoding the proteins constituting the PUFA-PKS may be introduced independently or a plurality of genes may be introduced in combination as long as a microorganism that expresses a protein complex having a PUFA-PKS activity, and that has the PS-DH domain having a higher activity against 3-hydroxyhexanoyl ACP than the FabA-DH domain is obtained finally.

The "gene" as used herein refers to a DNA that may contain a transcriptional regulatory region, a promoter region, and a terminator region, or the like in addition to a protein coding region. When a prokaryote such as a bacterium is used as a parent strain as a host organism, as the DNA, a plasmid in which a distance between the Shine-Dalgarno sequence that is a ribosome binding region and the start codon is adjusted to an appropriate distance (for example, 6 to 18 bases) is preferably used. In the DNA, a transcription termination factor is not always necessary for the expression of the DNA, but it is preferred to place the transcription termination sequence immediately downstream of the structural gene.

The gene to be introduced into the host organism can be introduced into a host cell by, for example, preparing a recombinant gene in which the gene is inserted downstream of the promoter of an appropriate expression vector. The expression vector can also contain a promoter, a transcription termination signal, or a selection marker gene for selecting a transformant (for example, a drug resistance gene such as a kanamycin resistance gene, a streptomycin resistance gene, a carboxin resistance gene, a zeocin resistance gene, or a hygromycin resistance gene, a gene that complements an amino acid auxotrophic mutation such as a leucine, histidine, methionine, arginine, tryptophan, or lysine auxotrophic mutation, or the like, a gene that complements a nucleobase auxotrophic mutation such as an uracil or adenine auxotrophic mutation, or the like). In the case of an uracil auxotrophic strain, as the marker gene, an orotidine-5'-phosphate decarboxylase gene (ura3 gene) or an orotidylate pyrophosphorylase gene (ura5 gene) can be used.

The promoter is defined as a base sequence of a DNA that initiates RNA synthesis by binding an RNA polymerase to the DNA regardless of whether it is a constitutive promoter or a regulatory promoter. A strong promoter is a promoter that initiates mRNA synthesis at a high frequency and is preferably used. A lac system, a trp system, a TAC or TRC system, major operator and promoter regions of a λ phage, a regulatory region of a fd coat protein, a promoter for a glycolytic enzyme (for example, 3-phosphoglycerate kinase or glyceraldehyde 3-phosphate dehydrogenase), glutamate decarboxylase A, or serine hydroxymethyltransferase, or the like can be used according to the properties of the host cell or the like.

In addition to the promoter and terminator sequences, as other regulatory elements, for example, a selection marker, an amplification signal, a replication origin, and the like are exemplified. As a preferred regulatory sequence, for example, sequences described in "Gene Expression Technology: Methods in Enzymology 185," Academic Press (1990) are exemplified.

The vector is not particularly limited as long as a target gene can be expressed. The types of reagents for constructing the vector, for example, restriction enzymes or ligation enzymes, or the like are also not particularly limited, and commercially available products can be used as appropriate.

The promoter when a Labyrinthulomycetes microorganism is used as the host organism is not particularly limited as long as it is a promoter that functions in the cells of the Labyrinthulomycetes microorganism, and examples thereof include an actin promoter, a tubulin promoter, an elongation factor Tu promoter, and a glycolytic gene expression promoter.

When a microorganism belonging to the genus Escherichia is used as the parent strain, as the expression vector, for example, pColdI (manufactured by Takara Bio, Inc.), pET21a, pCOLADuet-1, pACYCDuet-1, pCDF-1b, pRSF-1b (all manufactured by Novagen, Inc.), PMAL-c2x (manufactured by New England Biolabs, Inc.), pGEX-4T-1 (manufactured by GE Healthcare Biosciences, Inc.), pTrcHis (manufactured by Invitrogen, Inc.), pSE280 (manufactured by Invitrogen, Inc.), pGEMEX-1 (manufactured by Promega, Inc.) PQE-30 (manufactured by Qiagen, Inc.), pET-3 (manufactured by Novagen, Inc.), pTrc99A (manufactured by GE Healthcare Biosciences, Inc.), pKYP10 (JP-A-S58-110600), pKYP200 [Agric. Biol. Chem., 48, 669 (1984)], pLSA1 [Agric. Biol. Chem., 53, 277 (1989)], pGEL1 [Proc. Natl. Acad. Sci. USA, 82, 4306 (1985)], pBluescript II SK (+), pBluescript II KS (−) (manufactured by Stratagene Corporation), pTrS30 [prepared from Escherichia coli JM109/pTrS30 (Ferm BP-5407)], pTrS32 [prepared from Escherichia coli JM109/pTrS32 (Ferm BP-5408)], pTK31 [APPLIED AND ENVIRONMENTAL MICROBIOLOGY, 2007, Vol. 73, No. 20, pp. 6378-6385], pPAC31 (WO 98/12343), pUC19 [Gene, 33, 103 (1985)], pSTV28 (manufactured by Takara Bio, Inc.), pUC118 (manufactured by Takara Bio, Inc.), pPA1 (JP-A-S63-233798), pHSG298 (manufactured by Takara Bio, Inc.), and pUC18 (manufactured by Takara Bio, Inc.) are exemplified.

The promoter when using the above-mentioned expression vector is not particularly limited as long as it is a promoter that functions in cells of a microorganism belonging to the genus Escherichia, however, for example, a promoter derived from Escherichia coli, a phage, or the like such as a trp promoter (Ptrp), a lac promoter (Plac), a PL promoter, a PR promoter, a PSE promoter, or a T7 promoter can be used. Further, an artificially designed and modified promoter such as a promoter in which two Ptrps are connected in series, a tac promoter, a trc promoter, a lacT7 promoter, or a letI promoter can also be used.

When a coryneform bacterium is used as the parent strain, examples of the expression vector include pCG1 (JP-A-S57-134500), pCG2 (JP-A-S58-35197), pCG4 (JP-A-S57-183799), pCG11 (JP-A-S57-134500), pCG116, pCE54, pCB101 (all in JP-A-S58-105999), pCE51, pCE52, pCE53 [all in Molecular and General Genetics, 196, 175 (1984)], and the like.

The promoter when using the above-mentioned expression vector is not particularly limited as long as it is a promoter that functions in cells of a coryneform bacterium, however, for example, a P54-6 promoter [Appl. Microbiol. Biotechnol., 53, 674-679 (2000)] can be used.

When a yeast strain is used as the parent strain, examples of the expression vector include YEp13 (ATCC 37115), YEp24 (ATCC 37051), YCp51 (ATCC 37419), pHS19, pHS15, and the like.

The promoter when using the above-mentioned expression vector is not particularly limited as long as it is a promoter that functions in cells of a yeast strain, however, for example, promoters such as a PH05 promoter, a PGK promoter, a GAP promoter, an ADH promoter, a gal 1 promoter, a gal 10 promoter, a heat shock polypeptide promoter, an MFa1 promoter, and a CUP1 promoter are exemplified.

As a method of integrating a gene to be introduced into the chromosome of a host organism, a homologous recombination method can be used. As the homologous recombination method, for example, a method of introducing a recombinant gene by utilizing a homologous recombination system that can be produced by ligating the gene to a plasmid DNA having a drug resistance gene which cannot be autonomously replicated in a parent strain into which the gene is desired to be introduced can be exemplified. As a method utilizing homologous recombination frequently used in Escherichia coli, a method of introducing a recombinant gene by utilizing a homologous recombination system of a lambda phage [Proc. Natl. Acad. Sci. USA, 97, 6641-6645 (2000)] can be exemplified.

Further, a microorganism in which a target region on the chromosomal DNA of a parent strain has been substituted with a recombinant DNA can be obtained using a selection method utilizing the fact that E. coli becomes sensitive to sucrose by Bacillus subtilis levansucrase integrated on the chromosome together with a gene to be introduced, or a selection method utilizing the fact that E. coli becomes sensitive to streptomycin by integrating a wild-type rpsL gene into E. coli having a streptomycin-resistant mutant rpsL gene [Mol. Microbiol., 55, 137 (2005), Biosci. Biotechnol. Biochem., 71, 2905 (2007)], or the like.

In addition, as the homologous recombination method, for example, an ATMT method mediated by an Agrobacterium [Appl. Environ. Microbiol., (2009), vol. 75, pp. 5529-5535] is exemplified. Further, an improved ATMT method or the like is included, and the method is not limited thereto as long as a transformant that stably carries a target trait can be obtained.

As a method of introducing a gene to be introduced as a plasmid autonomously replicable in a host organism, for example, a method using calcium ions [Proc. Natl. Acad. Sci. USA, 69, 2110 (1972)], a protoplast method (JP-A-S63-248394), an electroporation method [Nucleic Acids Res., 16, 6127 (1988)], and the like can be exemplified.

It can be confirmed that a microorganism obtained by the above-mentioned method is a target microorganism by culturing the microorganism and detecting a PUFA accumulated in the resulting culture by gas chromatography, and also by evaluating whether or not the PS-DH domain exhibits a higher activity against 3-hydroxyhexanoyl ACP than the FabA-DH domain by the above-mentioned method.

[Method for Producing PUFA or PUFA-Containing Composition]

The present invention includes a method for producing a PUFA or a PUFA-containing composition, characterized by culturing the microorganism created above in a culture medium so as to produce and accumulate a PUFA or a PUFA-containing composition in a culture, and collecting the PUFA or the PUFA-containing composition from the culture.

The PUFA or the PUFA contained in the PUFA-containing composition is preferably an ω-6 PUFA, and for example, DPA or ARA can be exemplified. As the PUFA-containing composition, for example, a PUFA-containing oil or fat or a PUFA-containing phospholipid, preferably a PUFA-containing oil or fat can be exemplified. The culture of the microorganism can be obtained by inoculating the microorganism into an appropriate culture medium and culturing the microorganism according to a conventional method.

As the culture medium, any known culture medium containing a carbon source, a nitrogen source, and an inorganic salt, or the like can be used. For example, as the carbon source, in addition to carbohydrates such as glucose, fructose, and galactose, oils and fats such as oleic acid and soybean oil, glycerol, sodium acetate, and the like are exemplified. These carbon sources can be used, for example, at a concentration of 20 to 300 g per liter of the culture medium. According to a particularly preferred embodiment, the culture can be continuously carried out by feeding the carbon source after the initial carbon source is consumed. By carrying out the culture under such conditions, the amount of the carbon source to be consumed is increased, so that the production amount of the PUFA-containing composition can be improved.

Further, examples of the nitrogen source include organic nitrogen such as yeast extract, corn steep liquor, polypeptone, sodium glutamate, and urea, and inorganic nitrogen such as ammonium acetate, ammonium sulfate, ammonium chloride, sodium nitrate, ammonium nitrate, and ammonia. As the inorganic salt, potassium phosphate or the like can be used in combination as appropriate.

The culture medium containing the above-mentioned respective components is preferably used after adjusting the pH within a range of 4.0 to 9.5 by adding an appropriate acid or base, followed by sterilization in an autoclave. The culture temperature is generally from 10 to 45° C., preferably from 20 to 37° C. The culture temperature is preferably controlled to a culture temperature at which a PUFA-containing composition can be produced. The pH during culture is generally from 3.5 to 9.5, preferably from 4.5 to 9.5. The particularly preferred pH varies depending on the purpose, and is from 5.0 to 8.0 in order to produce a large amount of an oil or fat.

The culture time can be set to, for example, 2 to 7 days, and the culture can be carried out by aeration and agitation culture or the like. A method of separating the culture solution and the microorganism from the culture can be carried out by a conventional method known to those skilled in the art, for example, by centrifugation, filtration, or the like. The microorganism separated from the above culture is homogenized using, for example, ultrasonic waves, a dyno mill, or the like, followed by solvent extraction with, for example, chloroform, hexane, butanol, or the like, whereby the PUFA-containing composition can be obtained.

The PUFA-containing composition produced by the above-mentioned production method is subjected to, for example, a method such as a low temperature solvent fractionation method [Koretaro Takahashi, Journal of Japan Oil Chemist's Society, 40: 931-941 (1991)] or a method of releasing and removing short-chain fatty acids with a hydrolase such as a lipase [Koretaro Takahashi, Journal of Japan Oil Chemist's Society, 40: 931-941 (1991)] so as to concentrate the PUFA-containing composition, whereby the PUFA-containing composition having a high PUFA content can be obtained.

A PUFA can be produced by separating and collecting the PUFA from a PUFA-containing composition. For example, after preparing a mixed fatty acid containing a PUFA from a PUFA-containing composition by a hydrolysis method, the PUFA is separated and collecting by, for example, a urea addition method, a cooling separation method, high performance liquid chromatography, supercritical chromatography, or the like, whereby the PUFA can be produced.

Further, a PUFA alkyl ester can be produced by separating and collecting the PUFA alkyl ester from a PUFA-containing composition. The PUFA alkyl ester is not particularly limited as long as it is a PUFA alkyl ester, but preferably a PUFA ethyl ester is exemplified.

In order to separate and collect a PUFA alkyl ester from a PUFA-containing composition, for example, after preparing a mixed fatty acid alkyl ester containing a PUFA alkyl ester from the PUFA-containing composition by an alcoholysis method, the PUFA alkyl ester can be separated and collected by, for example, a urea addition method, a cooling separation method, high performance liquid chromatography, supercritical chromatography, or the like.

EXAMPLES

Hereinafter, Examples will be shown, however, the present invention is not limited to the following Examples.

Example 1

Method for Producing ARA [1]
1. Creation of Respective Expression Plasmids
[Creation of pET-phoA]

PCR was carried out using the genomic DNA of *Photobacterium profundum* SS99 (ATCC BAA-1252) strain extracted by a conventional method as a template and primers represented by SEQ ID NOS: 107 and 108, whereby a 3' end region (from the base at position 633 to the stop codon) of a DNA (a DNA composed of the base sequence represented by SEQ ID NO: 65) encoding PhoA protein was amplified.

The obtained DNA fragment was treated with restriction enzymes BamHI and EagI, and ligated to an *E. coli* vector pBluescript II SK(+) (manufactured by Agilent Technologies, Inc.) having been treated with the same restriction enzymes, whereby pBlue-PhoA-C-terminal was obtained.

Subsequently, PCR was carried out using the genomic DNA of *Photobacterium profundum* SS99 strain extracted by a conventional method as a template and primers represented by SEQ ID NOS: 109 and 110, whereby a 5' end region (from the start codon to the base at position 633) of the DNA encoding PhoA protein was amplified.

The obtained DNA fragment and an *E. coli* vector pET21a (manufactured by Merck Millipore Corporation) were each treated with restriction enzymes NdeI and EagI, and the resulting restriction enzyme-treated fragments were ligated to each other, whereby pET-PhoA-N-terminal was obtained.

Subsequently, pBlue-PhoA-C-terminal and pET-phoA-N-terminal were each treated with restriction enzymes EagI and XhoI, and the resulting restriction enzyme-treated fragments were ligated to each other, whereby pET-phoA was obtained.

[Creation of pACYC-SopfaE]

An expression plasmid pACYC-SopfaE having a DNA (a DNA composed of the base sequence represented by SEQ ID NO: 81) encoding EpaE protein derived from *Shewanella oneidensis* MR-1 (ATCC BAA-1096) strain was obtained by a method similar to that of Hayashi et al. (Sci. Rep., 2016, 6, 35441).

[Creation of pCOLA-phoD-phoB]

PCR was carried out using the genomic DNA of *Photobacterium profundum* SS99 strain extracted by a conventional method as a template and primers represented by SEQ ID NOS: 111 and 112, whereby a DNA fragment having a DNA (a DNA composed of the base sequence represented by SEQ ID NO: 71) encoding PhoD protein was amplified.

The obtained DNA fragment was treated with restriction enzymes NdeI and BamHI, and ligated to an *E. coli* vector pCOLADuet-1 (manufactured by Merck Millipore Corporation) having been treated with restriction enzymes NdeI and BglII, whereby pCOLA-phoD was obtained.

PCR was carried out using the genomic DNA of *Photobacterium profundum* SS99 strain extracted by a conventional method as a template and primers represented by SEQ ID NOS: 113 and 114, whereby a DNA fragment having a DNA (a DNA composed of the base sequence represented by SEQ ID NO: 67) encoding PhoB protein was amplified.

The obtained DNA fragment was treated with restriction enzymes NdeI and BamHI, and ligated to pACYC-SopfaE having been treated with restriction enzymes NdeI and BglII, whereby pACYC-epaE-phoB was obtained.

PCR was carried out using pACYC-epaE-phoB as a template and primers represented by SEQ ID NOS: 114 and 115, whereby a DNA fragment having a DNA encoding PhoB protein was obtained. Further, PCR was carried out using an *E. coli* vector pCOLADuet-1 (manufactured by Merck Millipore Corporation) as a template and primers represented by SEQ ID NOS: 116 and 117, whereby a DNA fragment of a T7 promoter region was amplified.

The obtained two DNA fragments were assembled by overlap extension PCR. The obtained DNA fragment and pCOLA-phoD were each treated with restriction enzymes ApaI and BamHI, and the resulting restriction enzyme-treated fragments were ligated to each other, whereby pCOLA-phoD-phoB was obtained.

[Creation of pCDF-phoC]

PCR was carried out using the genomic DNA of *Photobacterium profundum* SS99 strain extracted by a conventional method as a template and primers represented by SEQ ID NOS: 118 and 119, whereby a 5' end region (from the start codon to the base at position 993) of a DNA (a DNA composed of the base sequence represented by SEQ ID NO: 69) encoding PhoC protein was amplified.

The obtained DNA fragment and an *E. coli* vector pUC18 (manufactured by Takara Bio, Inc.) were each treated with restriction enzymes NdeI and XbaI, and the resulting restriction enzyme-treated fragments were ligated to each other. Subsequently, the obtained plasmid and pCDF-orfB (Sci. Rep., 2016, 6, 35441) were treated with restriction enzymes NdeI and BamHI, and the resulting restriction enzyme-treated fragments were ligated to each other, whereby pCDF-phoC-N-terminal was obtained.

Subsequently, PCR was carried out using the genomic DNA of *Photobacterium profundum* SS99 strain extracted by a conventional method as a template and primers represented by SEQ ID NOS: 120 and 121, whereby a 3' end region (from the base at position 933 to the stop codon) of a DNA encoding PhoC protein was amplified. The obtained DNA fragment and pCDF-phoC-N-terminal were treated with restriction enzymes NcoI and BamHI, and the resulting restriction enzyme-treated fragments were ligated to each other, whereby pCDF-phoC was obtained.

[Creation of pET-epaA]

PCR was carried out using the genomic DNA of *Shewanella oneidensis* MR-1 (ATCC BAA-1096) strain extracted by a conventional method as a template and primers represented by SEQ ID NOS: 122 and 123, whereby a DNA fragment having a DNA (a DNA composed of the base sequence represented by SEQ ID NO: 73) encoding EpaA protein was amplified.

The obtained DNA fragment and an *E. coli* vector pET21a (manufactured by Merck Millipore Corporation) were treated with restriction enzymes EcoRI and XhoI, and the resulting restriction enzyme-treated fragments were ligated to each other, whereby pET-epaA' was obtained.

Subsequently, overlap extension PCR was carried out using pET-epaA' as a template and primers represented by SEQ ID NOS: 124, 125, 126, and 127, whereby EpaA gene excluding the His-tag gene at the 5' end was amplified.

The obtained DNA fragment and pET-epaA' were treated with restriction enzymes ApaI and SalI, and the resulting restriction enzyme-treated fragments were ligated to each other, whereby pET-epaA was obtained.

[Creation of pET-araA]

PCR was carried out using pSTV29-Plac-pfaAB [FEBS Lett., 2014, 588(21), 4032-4036] as a template and primers represented by SEQ ID NOS: 128 and 129, whereby a DNA fragment having a DNA (a DNA composed of the base sequence represented by SEQ ID NO: 55) encoding AraA protein was amplified.

The obtained DNA fragment and an *E. coli* vector pET21a (manufactured by Merck Millipore Corporation) were treated with restriction enzymes NdeI and BamHI, and the resulting restriction enzyme-treated fragments were ligated to each other, whereby pET-araA was obtained.

[Creation of pACYC-epaE-araB]

PCR was carried out using pSTV29-Plac-pfaAB [FEBS Lett., 2014, 588(21), 4032-4036] as a template and primers represented by SEQ ID NOS: 130 and 131, whereby a DNA fragment having a DNA (a DNA composed of the base sequence represented by SEQ ID NO: 57) encoding AraB protein was amplified.

The obtained DNA fragment was treated with restriction enzymes NdeI and BamHI, and ligated to pACYC-SopfaE having been treated with NdeI and BglII, whereby pACYC-epaE-araB was obtained.

[Creation of pCDF-araC]

PCR was carried out using pMW219-Plac-pfaCD [FEBS Lett., 2014, 588(21), 4032-4036] as a template and primers represented by SEQ ID NOS: 132 and 133, whereby a DNA fragment having a DNA (a DNA composed of the base sequence represented by SEQ ID NO: 59) encoding AraC protein was amplified.

The obtained DNA fragment and pCDF-orfB (Sci. Rep., 2016, 6, 35441) were treated with restriction enzymes NdeI and BamHI, and the resulting restriction enzyme-treated fragments were ligated to each other, whereby pCDF-araC was obtained.

[Creation of pCOLA-araD]

PCR was carried out using pMW219-Plac-pfaCD [FEBS Lett., 2014, 588(21), 4032-4036] as a template and primers represented by SEQ ID NOS: 134 and 135, whereby a DNA fragment having a DNA (a DNA composed of the base sequence represented by SEQ ID NO: 61) encoding AraD protein was amplified.

The obtained DNA fragment was treated with restriction enzymes NdeI and BamHI, and ligated to an *E. coli* vector pCOLADuet-1 (manufactured by Merck Millipore Corporation) having been treated with restriction enzymes NdeI and BglII, whereby pCOLA-araD was obtained.

2. Production of ARA [1]

*E. coli* BLR(DE3)ΔfadE strain in which a gene encoding acyl-CoA dehydrogenase FadE (a protein composed of the amino acid sequence represented by SEQ ID NO: 106) has been deleted was created by a method similar to that of Hayashi et al. (Sci. Rep., 2016, 6, 35441).

E. coli BLR(DE3)ΔfadE strain was transformed using <1> pET-phoA, pCDF-phoC, pCOLA-phoD-phoB, and pACYC-SopfaE, or <2> pET-phoA, pCDF-phoC, pCOLA-phoD-phoB, and pACYC-epaE-araB.

The obtained E. coli was inoculated into 2 mL of Terrific Broth medium (manufactured by Becton, Dickinson and Company) containing 100 mg/L ampicillin, 20 mg/L kanamycin, 30 mg/L chloramphenicol, and 20 mg/L streptomycin, and subjected to shaking culture at 30° C. for 16 hours.

1 mL of the obtained culture solution was inoculated into a 200-mL flask equipped with a blade containing 20 mL of newly prepared Terrific Broth medium (manufactured by Becton, Dickinson and Company) containing 100 mg/L ampicillin, 20 mg/L kanamycin, 30 mg/L chloramphenicol, 20 mg/L streptomycin, and 1 mM IPTG, and the E. coli was cultured at 230 rpm and 20° C. for 48 hours.

After culture, the culture solution was collected, and a lipid was extracted by a Bligh-Dyer method [Bligh, e. G. and Dyer, W. J. (1959) Can. J. Biochem. Physiol. 37, 911-917], and then, a fatty acid was methylated using a boron trifluoride-methanol solution, and analyzed by gas chromatography-mass spectrometry.

The results of measuring ARA, EPA, dihomo-γ-linolenic acid (hereinafter referred to as DGLA), and eicosatetraenoic acid (hereinafter referred to as ETA) in the culture solution are shown in Table 3.

TABLE 3

| Strain | Carried PUFA-PKS genes | ARA [mg/L] | EPA [mg/L] | DGLA [mg/L] | ETA [mg/L] |
|---|---|---|---|---|---|
| <1> | phoA, phoB, phoC, phoD, epaE | N.D. | 22.9 ± 3.2 | N.D. | 4.2 ± 0.3 |
| <2> | phoA, phoB, phoC, phoD, epaE, araB | 5.9 ± 1.3 | 5.9 ± 1.4 | 5.7 ± 0.9 | N.D. |

As shown in Table 3, the E. coli that produces PhoA protein, PhoB protein, PhoC protein, PhoD protein, and EpaE protein mainly produced EPA and did not produce ARA, whereas the E. coli that produces also AraB protein in addition to PhoA protein, PhoB protein, PhoC protein, PhoD protein, and EpaE protein produced ARA in an amount equal to that of EPA.

Accordingly, it was found that by using the E. coli that produces AraB protein in addition to PhoA protein, PhoB protein, PhoC protein, and PhoD protein derived from an EPA-producing PUFA-PKS, ARA that is an ω-6 fatty acid can be efficiently produced.

3. Production of ARA [2]

E. coli BLR(DE3)ΔfadE strain was transformed using <3> pET-epaA, pCDF-phoC, pCOLA-phoD-phoB, and pACYC-SopfaE, or <4> pET-epaA, pCDF-phoC, pCOLA-phoD-phoB, and pACYC-epaE-araB.

The obtained E. coli was inoculated into 2 mL of Terrific Broth medium (manufactured by Becton, Dickinson and Company) containing 100 mg/L ampicillin, 20 mg/L kanamycin, 30 mg/L chloramphenicol, and 20 mg/L streptomycin, and subjected to shaking culture at 30° C. for 16 hours.

1 mL of the obtained culture solution was inoculated into a 200-mL flask equipped with a blade containing 20 mL of newly prepared Terrific Broth medium (manufactured by Becton, Dickinson and Company) containing 100 mg/L ampicillin, 20 mg/L kanamycin, 30 mg/L chloramphenicol, 20 mg/L streptomycin, and 1 mM IPTG, and the E. coli was cultured at 230 rpm and 20° C. for 48 hours.

After culture, the culture solution was collected, and a lipid was extracted by a Bligh-Dyer method, and then, a fatty acid was methylated using a boron trifluoride-methanol solution, and analyzed by gas chromatography-mass spectrometry.

The results of measuring ARA, EPA, DGLA, and ETA in the culture solution are shown in Table 4.

TABLE 4

| Strain | Carried PUFA-PKS genes | ARA [mg/L] | EPA [mg/L] | DGLA [mg/L] | ETA [mg/L] |
|---|---|---|---|---|---|
| <3> | epaA, phoB, phoC, phoD, epaE | N.D. | 29.4 ± 0.9 | N.D. | 5.4 ± 0.2 |
| <4> | epaA, phoB, phoC, phoD, epaE, araB | 8.2 ± 0.1 | 6.1 ± 0.2 | 7.0 ± 0.4 | N.D. |

As shown in Table 4, the E. coli that produces EpaA protein, PhoB protein, PhoC protein, PhoD protein, and EpaE protein mainly produced EPA and did not produce ARA, whereas the E. coli that produces also AraB protein in addition to EpaA protein, PhoB protein, PhoC protein, PhoD protein, and EpaE protein produced ARA in an amount equal to or more than that of EPA.

Accordingly, it was found that by using the E. coli that produces AraB protein in addition to EpaA protein, PhoB protein, PhoC protein, and PhoD protein derived from an EPA-producing PUFA-PKS, ARA that is an ω-6 fatty acid can be efficiently produced.

4. Production of ARA [3]

E. coli BLR(DE3)ΔfadE strain was transformed using <5> pET-araA, pCDF-araC, pCOLA-araD, and pACYC-epaE-araB, <6> pET-epaA, pCDF-araC, pCOLA-araD, and pACYC-epaE-araB, or <7> pET-phoA, pCDF-araC, pCOLA-araD, and pACYC-epaE-araB.

The obtained E. coli was inoculated into 2 mL of Terrific Broth medium (manufactured by Becton, Dickinson and Company) containing 100 mg/L ampicillin, 20 mg/L kanamycin, 30 mg/L chloramphenicol, and 20 mg/L streptomycin, and subjected to shaking culture at 30° C. for 16 hours.

1 mL of the obtained culture solution was inoculated into a 200-mL flask equipped with a blade containing 20 mL of newly prepared Terrific Broth medium (manufactured by Becton, Dickinson and Company) containing 100 mg/L ampicillin, 20 mg/L kanamycin, 30 mg/L chloramphenicol, 20 mg/L streptomycin, and 1 mM IPTG, and the E. coli was cultured at 230 rpm and 20° C. for 48 hours.

After culture, the culture solution was collected, and a lipid was extracted by a Bligh-Dyer method, and then, a fatty acid was methylated using a boron trifluoride-methanol solution, and analyzed by gas chromatography-mass spectrometry.

The results of measuring ARA, EPA, DGLA, and ETA in the culture solution are shown in Table 5.

TABLE 5

| Strain | Carried PUFA-PKS genes | ARA [mg/L] | EPA [mg/L] | DGLA [mg/L] | ETA [mg/L] |
|---|---|---|---|---|---|
| <5> | araA, araB, araC, araD, epaE | N.D. | N.D. | N.D. | N.D. |

TABLE 5-continued

| Strain | Carried PUFA-PKS genes | ARA [mg/L] | EPA [mg/L] | DGLA [mg/L] | ETA [mg/L] |
|---|---|---|---|---|---|
| <6> | epaA, araB, araC, araD, epaE | 29.4 ± 2.1 | N.D. | 1.2 ± 1.9 | N.D. |
| <7> | phoA, araB, araC, araD, epaE | 21.1 ± 1.7 | N.D. | N.D. | N.D. |

As shown in Table 5, in the case of the *E. coli* that produces AraA protein, AraB protein, AraC protein, AraD protein, and EpaE protein, the amount of any of the PUFAs was a detection limit or less, whereas the *E. coli* that produces EpaA protein, AraB protein, AraC protein, AraD protein, and EpaE protein, and the *E. coli* that produces PhoA protein, AraB protein, AraC protein, AraD protein, and EpaE protein produced a significant amount of ARA.

Accordingly, it was found that by using the *E. coli* that produces EpaA protein or PhoA protein, and AraB protein, AraC protein, and AraD protein, ARA that is an ω-6 fatty acid can be efficiently produced as compared with the case where the *E. coli* that produces AraA protein, AraB protein, AraC protein, and AraD protein that are proteins constituting a known ARA-producing PUFA-PKS was used.

Example 2

Method for Producing DPA

1. Creation of Respective Expression Plasmids

[pET-orfA]

An expression plasmid pET-orfA having a DNA (a DNA composed of the base sequence represented by SEQ ID NO: 83) encoding OrfA protein derived from *Schizochytrium* sp. (ATCC 20888) strain was obtained by a method similar to that of Hayashi et al. (Sci. Rep., 2016, 6, 35441).

[pCDF-orfB]

An expression plasmid pCDF-orfB having a DNA (a DNA composed of the base sequence represented by SEQ ID NO: 85) encoding OrfB protein derived from *Schizochytrium* sp. (ATCC 20888) strain was obtained by a method similar to that of Hayashi et al. (Sci. Rep., 2016, 6, 35441).

[pCOL92]

An expression plasmid pCOL92 having a DNA (a DNA composed of the base sequence represented by SEQ ID NO: 87) encoding orfC protein derived from *Schizochytrium* sp. (ATCC 20888) strain was obtained by a method similar to that of Hayashi et al. (Sci. Rep., 2016, 6, 35441).

2. Production of DPA

*E. coli* BLR(DE3)ΔfadE strain was transformed using <8> pET-orfA, pCDF-orfB, pCOL92, and pACYC-SopfaE, or <9> pET-orfA, pCDF-orfB, pCOL92, and pACYC-epaF-araB.

The obtained *E. coli* was inoculated into 2 mL of Terrific Broth medium (manufactured by Becton, Dickinson and Company) containing 100 mg/L ampicillin, 20 mg/L kanamycin, 30 mg/L chloramphenicol, and 20 mg/L streptomycin, and subjected to shaking culture at 30° C. for 16 hours.

1 mL of the obtained culture solution was inoculated into a 200-mL flask equipped with a blade containing 20 mL of newly prepared Terrific Broth medium (manufactured by Becton, Dickinson and Company) containing 100 mg/L ampicillin, 20 mg/L kanamycin, 30 mg/L chloramphenicol, 20 mg/L streptomycin, and 1 mM IPTG, and the *E. coli* was cultured at 230 rpm and 20° C. for 48 hours.

After culture, the culture solution was collected, and a lipid was extracted by a Bligh-Dyer method, and then, a fatty acid was methylated using a boron trifluoride-methanol solution, and analyzed by gas chromatography-mass spectrometry.

The results of measuring DPA, DHA, EPA, and ETA in the culture solution are shown in Table 6.

TABLE 6

| Strain | Carried PUFA-PKS genes | DPA [mg/L] | DHA [mg/L] | EPA [mg/L] | ETA [mg/L] |
|---|---|---|---|---|---|
| <8> | orfA, orfB, orfC, epaE | 13.7 ± 1.2 | 54.8 ± 1.7 | N.D. | N.D. |
| <9> | orfA, orfB, orfC, epaE, araB | 33.6 ± 2.4 | 5.5 ± 1.0 | N.D. | N.D. |

As shown in Table 6, the *E. coli* that produces OrfA protein, OrfB protein, OrfC protein, and EpaE protein mainly produced DHA, whereas the *E. coli* that produces also AraB protein in addition to OrfA protein, OrfB protein, OrfC protein, and EpaE protein produced DPA in an amount equal to or more than that of DHA.

Accordingly, it was found that by using the *E. coli* that produces also AraB protein in addition to OrfA protein, OrfB protein, and OrfC protein derived from a DHA-producing PUFA-PKS, DPA that is an ω-6 fatty acid can be efficiently produced.

The present invention has been described in detail with reference to the specific aspects, but it is obvious for those skilled in the art that various changes and modifications can be made without departing from the spirit and scope of the invention. The present application is based on a Japanese Patent Application (Patent Application No. 2018-151233) filed on Aug. 10, 2018, which is incorporated by reference in its entirety. Also, all references cited herein are incorporated in their entirety.

SEQUENCE LISTING (140 sequences)

SEQ ID NO: 1 - protein, 406 aa, Aureispira marina
DLLKGIFLIAKHIQADLTALGQKQRANFLTLTRLDGKLGLGKRNNTSVVGGGLSGLVKCLNLEWSSVFCRAIDAQPEWSDEQLAQQLMQELHDPNRGVVEVALSEEGRATLIATNDPVKAGQHITTAVTENSVFLVSGGARGVTANCVIEMAKAFQCKFILLGRSDASVELPDFAKNESEEGALKRAIMLDMKAKGQQPNLAEVKKMFNSIIAKKEIEDTLQAIEKAGGEAIYIKGDVTKVSSVKPQLLAITQQWGPITGVLHGAGRLADKYIQDKSEQDFINVLSVKLDGLLTLLQCVNLQKLEHLILFSSVAGFYGNVGQTDYAIANEILSKAAHQFRTNHPNTQVSAINWGAWDAGMVSEALKKKFEAMGVSLVNSVGGPALLVNELNVAYANQPQVILGGTL

SEQ ID NO: 2 - protein, 260 aa, Aureispira marina
RTLEPSENPFLQHHVIQGQAVLPVVSAMGWMATTAEQIFPDFRTFEVANTKLFKGLVFDGNQPKAFVTTLVEKEKNASTIVLEATISSQAPTAKLPTFHYKATLTLKAKNLGLEQPTFEATLSSDYTASSGAVLYENGALFHGKHFQGIEEILDWNEHQIVLKCKAPQVSRAEQGQFPILGVNTFFADIQYQGMVIWVQKYHDGAKSLPLATESAQLFAPVPFDKELLVHIEIVEDTPFKMVANCTTYDADGKVYLSTRN

SEQ ID NO: 3 - protein, 440 aa, Aureispira marina
MKIAIIGLSGLFPGSSTNEEFWQNLLDEKDLTNLANLEDFGADPALFYEDKKGAVDRCYSLRGGYIRDFDFDPTGYQLSADFLAQQDKLYQWSLYVAKTALEESGYAHNKEVLAKCGLILGNLSFPTGSSHKLLADLYTKTTEKALQELLEDKNFKIPASQLPIPNNEVLADTPSQMVAKGLGLGGGHYALDAACATSLYAIKLACDELITGKADLMLAGAVCGSDQLFIHMGFSIFHAYAPHGEKFAPLDKASGGLVSAEGAGMVVLKRLEDAERDGDNILGLIGGIGLSNDGSGKFLLSPNPKGQRLAFERAYDLEEVLPQNTSYLECHATGTPLGDVTEMNSISDFFAQHQTKPLLGSVKSNMGHLLTAAGMSGLFKVLLSMQKGIIPPNINLESAVQANNQWIQDEQIIKKTTPWKGDQAGINSFGFGGTNAHMVV

SEQ ID NO: 4 - protein, 410 aa, Aureispira marina
PLAIVGMDAHFGSCENLEDFYAAIYNGNQDFKPLPPKRWKGFDADQDLLKRYGFKDGLAPKGAYIDQFDIDLLRYKIQPKEAETLEPQQALILKVADKALQDAQISPSQNIAVLIAMESELAIHHYLARWDSVWQLDKALEQSGLSLSEEKKTALKEYSKNALYFREGSQTPSQHTSFVGNIMASRIAALWDFSGPAFTVSCGDNAVFKALEVAQNILSLGEVDAVVVGGVDFCGGLENVLLRQEKEASSQNIAPSLSLNQGQKGWLVGEGAGAVVLKRQIDLQKQDNVYAVLEHIGQASEQLNVGYQELVSSGYAAQDHQELKQLLATQLEQKTALGSVKTSFGHTGAASGIAALIKTALCLHHKFIPGIPNWEAPQEATAFAKTKYYFPMASRPWLLNAGEKRKAAIN

SEQ ID NO: 5 - protein, 296 aa, Aureispira marina
GKIAFSYPGSATAYRGLGQDIFQLFPSLHEHFGQKLEDIADFVGSSYLHPKLQSRQEEAPSIQTDAVSMMCAGVFSSAIYTHLLKDKFGLKPDLAFGYSMGESAGMWYSFDVWNPDNTAVFRNSDLFANQLSGDLRLLAETWGISSEEAKARWISLILLADKEAVQNLVAQEDRCYLSFINTPQEVIISGDKEACNRVVQQLGCPAVEVPFQNVIHHDFCKKVQEELYDMHHFPLETQPNIDFYSSLSLAPLPMDSGVIAQNSTQVCFQPVDYPTTIQQLYNDGARIFIELGAGNT

SEQ ID NO: 6 - protein, 150 aa, Aureispira marina
LRLPPEQILMIDRIVSVDLKGGAYGLGYVIAEKDLAPEDWYFPCHFRDDEVLAGSLQAEGGGNLLRFFMLMLGLQRLTKDARYQPIFDLPQKVRCRKQVTPSKDTKLVYKLEVKEIGLVPNPYVIADLEIVSDGVITVHFENLGLQLREK

SEQ ID NO: 7 - protein, 149 aa, Aureispira marina
YHLSGEQLSLLNNLKIVKDGGQYGKGYIYGHQAINLYDWFFTCHFYQDPVMPGSLGVEAILQAMQTFALQQDLGKDFKSPRFVQVPQHTTVWKYRGQILQGVENMHCEVHFKSIEKKGEQLVIVGDAYLWNEDTRIYQITDLALGIEEA

SEQ ID NO: 8 - protein, 417 aa, Aureispira marina
LGDATFRKDYKLKYAYKTGAMANGIASEDLVIAMGKAGLLGSFGAAGLIPSRVEQAIDTIQQALPTQSYAFNLIHSPNEPALEEGAVKHFLARGVNVVEASAFLNLTLNIVHYRVAGLSQDEEGNVIIGNRVIAKISRQEVARHFMQPAPQKYLDKLLEAGKITPLQAQLAARVPMADDITVEADSGGHTDNRPLVALLPSIIRQRDQLQAQYQFSTPIRVGAAGGIGTPEAALSAFMMGAAYVVTGSINQACIEAGTSEHVRKLLANVAQTDVMMAPASDMFEMGVELQVLKRGTLFGPRAKKLYEYYMQYNSIDEIPAAEREKLEKQTFKKPLEEVWQGCISFFEERDPSQIERAKNNPKRKMALIFRWYLGLSSNWANAGVKERISDMQIWCGPAMGSFNDWVKGTYLEDYQKR

SEQ ID NO: 9 - protein, 518 aa, Photobacterium profundum SS9
MPIAIVGMASMFANSRYLNKFWDLISEKIDAITEVPETHWRPEDYYDANKSTPDKSYCKRGGFIPEVDFNPMEFGLPPNILELTDTSQLLSLIVAKEVLADAKLPETYDRDKIGITLGVGGGQKISQSLNARLQYPVLKKVFKNSGITDEDSEMLIKKFQDQYIHWEENSFPGSLGNVISGRIANRFDLGGMNCVVDAACAGSLAALRMALSELVEGRSEMMITGGVCTDNSPTMYMSFSKTPAFTTNETIQPFDIDSKGMMIGEGIGMIALKRLEDAERDGDRIYSVIKGVGASSDGKFKSIYAPRPEGQAKALKRAYDDAGFAPHTLGLLEAHGTGTAAGDVAEFSGLNSVFSEGNDEKQHIALGSVKSQIGHTKSTAGTAGLIKASLALHHKVLPPTINVTSPNPKLNIEDSPFYLNTQTRPWMQRVDGTPRRAGVSSFGFGGTNFHIVLEEYTPEHARGDKYRQRQVAQTLLFSAASREALIASLKETSANLANDSVNLETLAESHGLRSIEVS

SEQ ID NO: 10 - protein, 302 aa, Photobacterium profundum SS9
SAKVAALFAGQGSQYLNMGRELACHYPEMRQQLAKADQVFGQNKKTALSQVLFPIPMFNKESTQAQEALLTNTANAQSAIGVMSMGQFELLTQAGFKADMVAGHSFGELSALCASGVISQDDYYQLAFARGNAMAATPAEGDSGTMYAVILDADKLADVEKCISAFEGVSIANYNAPTQLVIAGPTDSAQLAAKALTEQGFKAIPLPVSGAFHTPLVAHAQKPFAAAIDKATFSTPALPLYSNATGELHKNDGKAIKKAFKQHMLQSVRFSTQLEAMYDAGARVFVEFGPKNILQKLVEKTL

SEQ ID NO: 11 - protein, 69 aa, Photobacterium profundum SS9
QVMLEVVAEKTGYPTEMLDLDMDMEADLGIDSIKRVEILGTVQDQMPNLPELSPEDLAECRTLREIVTY

SEQ ID NO: 12 - protein, 413 aa, Photobacterium profundum SS9
VTLHATAKESISMAFLFAKLLKTQLNAAKNRSAFFTVSRIDGGFGYLNAEQLINAELNQAALSGLTKTLSHEWSTVFCRALDVAPTLDARHLAEAVTAELFDIDTHTVEVGLADANNGESGRATLIATNAGTALTKNASAKLDKNDNVLVTGGAKGVTFECALTLAKQCKSHFILAGRSQHITANELPEWAQGKQANELKPAAIRHIQTSGEKPTPKKVDALLKPVLSSLEINTALSAFANVGASAEYISLDVSSSDSVAKTLSQFNDITGLIHGAGVLADKHIQDKTLDELNLVYGTKVGGLEAVLNALNSDKLKLVAMFSSAAGFYGNTGQSDYAMSNEILNKAALQLSARNPEAKVMSFNWGPWDGGMVNAALKKMFTDRGVYVIPLQAGAELFSSQLLSETGIQLLVGT

SEQ ID NO: 13 - protein, 264 aa, Photobacterium profundum SS9
SPLNSSITVTRDLDPKAMPFINDHCIAGNPVLPTVCAIQWMREAAEQLLGANVTVRDYKLLKGVIFDTNEIQTLTLTLTPDEKATDQIKALISCQDRPQYKAMLVVEPVPATQAKTFVANSNEPITTAKALYSNGTLFHGPRLQGITTVERFDDAGLLAQCQLPTVADTDCGAFVPTQHLGGCQPFAEDYLLQAMLVWARLKYGAASLPSAIGEFVSYEPMQAGDKGWLELDVIKNTTRSLQANISLYHQDGRLSAVMKSAKVT

SEQ ID NO: 14 - protein, 299 aa, Photobacterium profundum SS9
FVYPGVGTVYPGMFRDFHQYFPALFAQLEREGNLKEMLQAEKTYGENPAEMTLGELAIAGVGSSYLLTQLLCEEFAVKPDFALGYSKGEASMWASLGVWKNPHALIELTQTSPIFTTAISGKLTAVREAWQLTDAEEITWNSFVVRCESATIEALLPEFPRAYLAIIQGDTCVLAGCEATCRALLKKLGKRGIAANRVTAMHTTPALSQHSQVTEFYTQPLCDELPMDIKFISAAGLLPQNQNVPVNIDSQSIANSIADTFCTTLDFTALIRTAREQGARLFVEIGADRQTSTLIDKIN

SEQ ID NO: 15 - protein, 453 aa, Photobacterium profundum SS9
NKIAIVGLANQYPDADTPKDFWQNLLAKKDSRTTLSPDKLGANPDAYQGIQGESDRFYCDKGGYIQNFSFDSNGYRLPAETFEGLDESFLWALDTSRKALADAGIPLDDAVLERTGVIMGALSFPTKRSNDLFLPIYHSAVEKALQTKLGNEHFTLTPSNANITSLNPANGSAAHNASRLVADALGLGSVQLSLDAACASSVYSLKLACDYLNTGKADMMLAGAVSGADPFFINMGFSIFHAYPDHGVSVPFDTNSKGLFAGEGAGVLILKRLEDAERDGDNIYAVVSGIGLSNDGRGQFVLSPNSKGQVQAFERAYEATDLSPESIEVIECHATGTPLGDKVEMTSMERFFADKLNGSQAPLIGSAKSNLGHLLTAAGMPGIMKMIFAMKEGVLPPSINLSTPLSSPEGLFGSHTLPTQVQAWPDKAGNTERCAGVSVFGFGGCNAHLLLEA

SEQ ID NO: 16 - protein, 368 aa, Photobacterium profundum SS9
VTGLASHFGSLKTINALHNAITTGADAFVALPKKRWKGLDQHPELLSQFGLDAIPHGAYIDQFELDFLRFKVPPNEDDRLISQQLLLMKVADEAIRDAKLEVGQKVAVLVAMETELEMHQFRGRVNLHTQLADSLENMGVQLTDSEYQALEAIAMDSVLDAAKLNQYTSFIGNIMASRIASLWDFNGPAFTISAAEQSVARCIDVAQNLMSQESLDAVVIAAVDLSGSVEQIILKNSVTPVALHPQDSGWNVGEGAGAIVLVDTDNASTKNSYGEITALDFGSVAQSNITSDRLLTTAGITANNVSLLELNQAPESVETVQFPLPSATHIQANQRLGHCYAASGMASILHGLLSLNAIPKQTTIPSLN

SEQ ID NO: 17 - protein, 144 aa, Photobacterium profundum SS9
SDKFMMIEQISHVDPQGGTWGLGLIEGHKQLEADHWYFPCHFKDDSVMAGSLMAEGCGQLLQFFMMYLGMHTQVENGRFQPLENAPQQVRCRGQVLPQSAVLTYRMEVTEIGLSPRPYAKANIDILLDGKVVVDFQNLGVMIKE

SEQ ID NO: 18 - protein, 148 aa, Photobacterium profundum SS9
YQLAGGRLNFIDKVDITSDGGKAGLGYLYAERTIDPSDWFFQFHFHQDPVMPGSLGVEAIIELMQTYALNKDLGAGFRSPKFGQIQSEVKWKYRGQINPLNKQMSLDVHITAIKDEDGKRIIVGDANLSKDGLRIYEVKDIAICIEEA

SEQ ID NO: 19 - protein, 442 aa, Photobacterium profundum SS9
LGTQSLGDNDFRRVHGVKYAYYAGAMANGISSEELVIALGQAGILCSFGAAGLIPSRVEQAINRIQAALPNGPYAFNLIHSPSEPALERGSVELFLKHKVRTVEASAFLGLTPQIVQYRAAGLSRDAQGEIVIANKVIAKVSRTEVAIKFMEPAPAKMLQGLVDEGRITAEQMELALLVPMADDITAEADSGGHTDNRPLVTLLPTILALKETIQAKHQFKTPLRVGSGGGIGTPDAALAAFNMGAAYIVTGSINQACIEAGASEHTRKLLATTEMADVAMAPAADMFEMGVKLQVVKRGTLFPMRANKLYEIYTRYDSIEAIPADERHKLETQVFHSTLDAIWEGTVAHFNERDPKQIERAQGNPKRKMALIFRWYLGLSSRWSNTGEAGREMDYQIWAGPALGAFNAWAKGSYLDNYQDRRAVDLTKHLMHGAAYLARVN

SEQ ID NO: 20 - protein, 453 aa, Shewanella oneidensis MR-1
MPIAIVGMASIFANSRYLNKFWDLICDKIDAITDVPASHWAIDDYYDVDKSKADKSYCKRGGFMPEVDFNPMEFGLPPNILELTDSSQLLSLVVAKEVLQDANLPDDYDRDRIGITLGIGGGQKLSHSLNARLQYPVLKKVFKSSGLSDEDSELLIKKFQDQYVHWEENSFPGSLGNVIAGRIANRFDLGGMNCVVDAACAGSLAAMRMALTELTEGRSDMMITGGVCTDNSPYMYMSFSKTPAFTTNEQIQPFDIDSKGMMIGEGIGMVALKRLDDAERDGDRIYAVIKGVGASSDGKFKSIYAPRPEGQAKALERAYDDAGFAPHTVGLIEAHGTGTAAGDVAEFTGLSSVFSQDNAQLQHIALGSVKSQVGHTKSTAGTAGVIKAALALHHKVLPPTINVSKPNPKLEIDRSPFYLNTEARPWIQRSDDTPRRAGISSFGFGGTNFHLVL

SEQ ID NO: 21 - protein, 303 aa, Shewanella oneidensis MR-1
QTKIAALFAGQGAQYLNMGLELANNFPELRRHIHASDKVFSTHGKPALSSVLYPIPAFDDESIKAQETALTNTLYAQSAIGALSMAQYALFTQAGFAPDMLAGHSFGELSALCAAGVISMDDYIKLAFERGQAMAQSSQDTDAGVMYAVILKQKQDIEVINGCLAQFEGVKVANYNSPTQLVIAGASAATQQAAKAISELGFKAIALPVSGAFHTPLVAHAQKPFSAAIDKAQFNTPKIALYANGTGQLHPIDANAIKAALKDHMLQSVHFSEQLEAMYAAGARVFVEFGPKNILQKLTENTL

SEQ ID NO: 22 - protein, 70 aa, Shewanella oneidensis MR-1
HAMLSVVADKTGYPVEMLELSMDMEADLGIDSIKRVEILGTVQDELPNLPELSPEDLAECRTLGEIVALF

SEQ ID NO: 23 - protein, 354 aa, Shewanella oneidensis MR-1
SQSELNQAALFGLTKTLNHEWPGVVCRALDIAPNLDAKTVANAVVQEYYLQDAPVEVGIDSNFDRVTLVAGTAALRHPPAVLSNADKILVTGGAKGVTFECALSLAKRCQAHFFLAGRSAHQVIPAWAEGKKSNELKAAAIAHLQSLGDKPTPKQVDALVWPVQSSLEISHALAAFDAIGASAEYLSVDVNDPAAIASTIAPINALSPITGIIHGAGVLADKHIQDKTLNEFERVYGTKVTGLNNLLSTLDLSQVKLIALFSSAAGFYGNTGQSDYAMSNDILNKAALQLAQQLPQAKVMSFDWGPWDGGMVNPALKKMFIDRGVYVIPLKAGAELFASQLLSDTGAQLLVGTD

SEQ ID NO: 24 - protein, 275 aa, Shewanella oneidensis MR-1
PQSIRVMRSLDPKRMSFIEDHCINGHAVLPTVCAIDWMREAAKAHLGTAVSVSDYRLLKGVIFDEALLARNAPIELELMLTPLADAAQQSTEALAALISFEGRPQYQAVLVAQTDDMPDAQRFEVGELHSLIQEMAQQPAIANRESLYSDGTLFHGPRLQGISEVLTFDDQHLMAKVELPQVALDDCGKFAPKLEDKGTQPFAEDLLLQAMLVWARLKYQAASLPSTIGEFVSYAPLSFGEKAVLVLDVLKHSSRSLEANIALYHQDGRLSCEMK

SEQ ID NO: 25 - protein, 526 aa, Shewanella oneidensis MR-1
YWFSKPHQARVLSLNLFDKAPQAQTAQSLILTQGTGLIAQPLLNANRLFIPISGNEFESLTLKLLQLIDSLTLSLNQPDTDWLSSQGSDWFKRYQAKDELALVLMAGSLEELMQEAKAMQTFIEKARLTIESSASKHSASKPSASTSLVFKTPAGSYFAASPLGDKGLTFVYPGVGTVYPNMFSDLHSYFPELYRELEREGDLAAMLQAETIYQDAAYAKTAVNVSVKDTAEMSLSQLAISGVGASYLFSKLLTGVFTIQPRLALGYSMGEAAMWASLAIWQTPHSLIDATQGSAIFNHEISGKLQAVRRDWQLNEDAPLAWNSFLVRATSTEINPLLADFPRVYLAIEQGDTCILAGCEASCLQLLARLNKRGIASNKVTAMHTAPSQSQRNAIQGFYTLGLKATACETQVRFISAAQHSPVNIDSMSIAKSIADTFCAPLNFTALINTAYNQGARLFVEVGADRQTSTLIDKISRQLELGADGVQEPILAMACNAKGSDTIVSLLKCLAQLISHRVPLSLAALM

SEQ ID NO: 26 - protein, 451 aa, Shewanella oneidensis MR-1
IAIVGLAVQYPDADTPEQFWQNLLDKKDSRSQIDAAKLNANPADYQGIQGQADRFYCDKGGYIRNFRFDPQGYQLLPATFAGLDESFLWALDCSKKALLNAGVDLTAPLLERTGIVMGTLSFPTARSNELFLPIYHQAVEKALKTKLNQPQFALAPFANASIAGSQLAANGVIAHTASKLLSDALGLGGAQLSLDAACASSVYALKLACDYLTTGKADMMLAGAVSGADPFFINMGFSIFHAYPDHGISAPFDSNSKGLFAGEGAGVLVLKRLEDAERDGDNIYAVVSGIGLSNDGKGQFVLSPNSKGQVQAFERAYAAANTHPSNIEVIECHATGTPLGDKVELTSMERFFEDKLDGTKAPLIGSAKSNLGHLLTAAGMPGIMKMIFAMRSGHLPPSINLTAPISSPKGLFSVNNLPTQRQAWPDKAGNDRRHAGVSVFGFGGCNAHLLL

SEQ ID NO: 27 - protein, 288 aa, Shewanella oneidensis MR-1
VIGMASHFGPLASINALDKALIAQTDAFIPLPPKRWKGLDKHPDILQQFGLNRAPKGAYIEQFDFDFLRFKVPPNEDDRLISQQLLLIKVADEAIRDAKLTAGSKVAVLVAMETELELHQFRGRVNLHTQLADSLKKQGVHLSNDEYLALEAIAMDSVLDAAKLNQYTSFIGNIMASRIASLWDFNGPAFTISAAEQSVARCIDVAQNLLSKEALDGVVIAAVDLSGSVEQVILKNAQVAVDLDANSANPQWKVGEGAGAIVLTNQQASNSQQAGYGQIRGQAFGTNH

SEQ ID NO: 28 - protein, 147 aa, Shewanella oneidensis MR-1
KFLMIEQVSKLEVHGGAWGLGLIEGHKQLAPDHWYFPCHFKGDQVMAGSLMAEGCGQLLQFFMLHIGMHANTQAGGVTNGRFQPLENASQKVRCRGQVLPQSGTLTYRMEVTEIGMSPRPYAKANIDILLNGKVVVDFQNLGVMIKE

SEQ ID NO: 29 - protein, 148 aa, Shewanella oneidensis MR-1
YRLAGGQLNFIDKAEIVKTGGKKGLGYLYAERTIDPSDWFFQFHFHQDPVMPGSLGVEAIIELLQTYAIDQDLGAGFNNPKFGQILSEIKWKYRGQINPLNKQMSLDVHITSIEDKDGKRIIKGDANLSKDGLRIYEVTDIAICIEEA

SEQ ID NO: 30 - protein, 442 aa, Shewanella oneidensis MR-1
LGTQSLGDSNFRRVHGVKYAYYAGAMANGIASEELVIALGQAGILCSFGAAGLIPSRVEAAIKRIQAALPNGPYAFNLIHSPSEQALERGSVELFLKHQVRTVEASAFLGLTPQIVYYRAAGLSRDASGEIVIGNKVIAKISRTEVATKFMEPAPVKILQQLVNEGLISEDQMLMAQSVPMADDITAEADSGGHTDNRPLVTLLPTILALKDTIQAKYQYKTPIRVGAGGGIGTPDAALATFNMGAAYIVTGSINQACVEAGASEHTRKLLATTEMADVTMAPAADMFEMGVKLQVVKRGTLFPMRANKLYEIYTRYDSIEAIPAEERQKLEEQVFRASLDEIWAGTVAHFNERDPKQIERALDNPKRKMALIFRWYLGLSSRWSNTGEVGREMDYQIWAGPALGAFNAWAKGSYLDDYRERNAVDLAKHLMQGAAYQARIN

SEQ ID NO: 31 - protein, 408 aa, Schizochytorium sp.
DTRIAIIGMSAILPCGTTVRESWETIRAGIDCLSDLPEDRVDVTAYFDPVKTTKDKIYCKRGGFIPEYDFDAREFGLNMFQMEDSDANQTISLLKVKEALQDAGIDALGKEKKNIGCVLGIGGGQKSSHEFYSRLNYVVVEKVLRKMGMPEEDVKVAVEKYKANFPEWRLDSFPGFLGNVTAGRCTNTFNLDGMNCVVDAACASSLIAVKVAIDELLYGDCDMMVTGATCTDNSIGMYMAFSKTPVFSTDPSVRAYDEKTKGMLIGEGSAMLVLKRYADAVRDGDEIHAVIRGCASSSDGKAAGIYTPTISGQEEALRRAYNRACVDPATVTLVEGHGTGTPVGDRIELTALRNLFDKAYGEGNTEKVAVGSIKSSIGHLKAVAGLAGMIKVIMALKHKTLPGTINVD

SEQ ID NO: 32 - protein, 331 aa, Schizochytorium sp.
ALFSGQGAQYTHMFSEVAMNWPQFRQSIAAMDAAQSKVAGSDKDFERVSQVLYPRKPYEREPEQDHKKISLTAYSQPSTLACALGAFEIFKEAGFTPDFAAGHSLGEFAALYAAGCVDRDELFELVCRRARIMGGKDAPATPKGCMAAVIGPNAENIKVQAANVWLGNSNSPSQTVITGSVEGIQAESARLQKEGFRVVPLACESAFHSPQMENASSAFKDVISKVSFRTPKAETKLFSNVSGETYPTDAREMLTQHMTSSVKFLTQVRNMHQAGARIFVEFGPKQVLSKLVSETLKDDPSVVTVSVNPASGTDSDIQLRDAAVQLVVAGV

SEQ ID NO: 33 - protein, 66 aa, Schizochytorium sp.
VMEVLAAKTGYETDMIESDMELETELGIDSIKRVEILSEVQAMLNVEAKDVDALSRTRTVGEVVNA

SEQ ID NO: 34 - protein, 230 aa, Schizochytorium sp.
VLLVSGGARGITPLCIREITRQIAGGKYILLGRSKVSASEPAWCAGITDEKAVQKAATQELKRAFSAGEGPKPTPRAVTKLVGSVLGAREVRSSIAAIEALGGKAIYSSCDVNSAADVAKAVRDAESQLGARVSGIVHASGVLRDRLIEKKLPDEFDAVFGTKVTGLENLLAAVDRANLKHMVLFSSLAGFHGNVGQSDYAMANEALNKMGLELAKDVSVKSICFGPWDG

SEQ ID NO: 35 - protein, 282 aa, Schizochytorium sp.
AEILVGNWRTPSKKVGSDTITLHRKISAKSNPFLEDHVIQGRRVLPMTLAIGSLAETCLGLFPGYSLWAIDDAQLFKGVTVDGDVNCEVTLTPSTAPSGRVNVQATLKTFSSGKLVPAYRAVIVLSNQGAPPANATMQPPSLDADPALQGSVYDGKTLFHGPAFRGIDDVLSCTKSQLVAKCSAVPGSDAARGEFATDTDAHDPFVNDLAFQAMLVWVRRTLGQAALPNSIQRIVQHRPVPQDKPFYITLRSNQSGGHSQHKHALQFHNEQGDLFIDVQASV

SEQ ID NO: 36 - protein, 425 aa, Schizochytorium sp.
IAVVGMAVQYAGCKTKDEFWEVLMNGKVESKVISDKRLGSNYRAEHYKAERSKYADTFCNETYGTLDENEIDNEHELLLNLAKQALAETSVKDSTRCGIVSGCLSFPMDNLQGELLNVYQNHVEKKLGARVFKDASHWSEREQSNKPEAGDRRIFMDPASFVAEELNLGALHYSVDAACATALYVLRLAQDHLVSGAADVMLCGATCLPEPFFILSGFSTFQAMPVGTGQNVSMPLHKDSQGLTPGEGGSIMVLKRLDDAIRDGDHIYGTLLGANVSNSGTGLPLKPLLPSEKKCLMDTYTRINVHPHKIQYVECHATGTPQGDRVEIDAVKACFEGKVPRFGTTKGNFGHTLVAAGFAGMCKVLLSMKHGIIPPTPGIDDETKMDPLVVSGEAIPWPETNGEPKRAGLSAFGFGGTNAHAVFEE

SEQ ID NO: 37 - protein, 425 aa, Schizochytorium sp.
MRIAITGMDATFGALKGLDAFERAIYTGAHGAIPLPEKRWRFLGKDKDFLDLCGVKATPHGCYIEDVEVDFQRLRTPMTPEDMLLPQQLLAVTTIDRAILDSGMKKGGNVAVFVGLGTDLELYRHRARVALKERVRPEASKKLNDMMQYINDCGTSTSYTSYIGNLVATRVSSQWGFTGPSFTITEGNNSVYRCAELGKYLLETGEVDGVVVAGVDLCGSAENLYVKSRRFKVSTSDTPRASFDAAADGYFVGEGCGAFVLKRETSCTKDDRIYACMDAIVPGNVPSACLREALDQARVKPGDIEMLELSADSARHLKDPSVLPKELTAEEEIGGLQTILRDDDKLPRNVATGSVKATVGDTGYASGAASLIKAALCIYNRYLPSNGDDWDEPAPEAPWDSTLFACQTSRAWLKNPGERRYAAVS

SEQ ID NO: 38 - protein, 529 aa, Schizochytorium sp.
SRAWLKNPGERRYAAVSGVSETRSCYSVLLSEAEGHYERENRISLDEEAPKLIVLRADSHEEILGRLDKIRERFLQPTGAAPRESELKAQARRIFLELLGETLAQDAASSGSQKPLALSLVSTPSKLQREVELAAKGIPRCLKMRRDWSSPAGSRYAPEPLASDRVAFMYGEGRSPYYGITQDIHRIWPELHEVINEKTNRLWAEGDRWVMPRASFKSELESQQQEFDRNMIEMFRLGILTSIAFTNLARDVLNITPKAAFGLSLGEISMIFAFSKKNGLISDQLTKDLRESDVWNKALAVEFNALREAWGIPQSVPKDEFWQGYIVRGTKQDIEAAIAPDSKYVRLTIINDANTALISGKPDACKAAIARLGGNIPALPVTQGMCGHCPEVGPYTKDIAKIHANLEFPVVDGLDLWTTINQKRLVPRATGAKDEWAPSSFGEYAGQLYEKQANFPQIVETIYKQNYDVFVEVGPNNHRSTAVRTTLGPQRNHLAGAIDKQNEDAWTTIVKLVASLKAHLVPGVTISPL

SEQ ID NO: 39 - protein, 449 aa, Schizochytorium sp.
CNIADLGSRAFMKTYGVSAPLYTGAMAKGIASADLVIAAGRQGILASFGAGGLPMQVVRESIEKIQAALPNGPYAVNLIHSPFDSNLEKGNVDLFLEKGVTFVEASAFMTLTPQVVRYRAAGLTRNADGSVNIRNRIIGKVSRTELAEMFMRPAPEHLLQKLIASGEINQEQAELARRVPVADDIAVEADSGGHTDNRPIHVILPLIINLRDRLHRECGYPANLRVRVGAGGGIGCPQAALATFNMGASFIVTGTVNQVAKQSGTCDNVRKQLAKATYSDVCMAPAADMFEEGVKLQVLKKGTMFPSRANKLYELFCKYDSFESMPPAELARVEKRIFSRALEEVWDETKNFYINRLHNPEKIQRAERDPKLKMSLCFRWYLSLASRWANTGASDRVMDYQVWCGPAIGSFNDFIKGTYLDPAVANEYPCVVQINKQILRGACFLRRLE

SEQ ID NO: 40 - protein, 202 aa, Schizochytorium sp.
YKLCARKMLMIDRVTSIDHKGGVYGLGQLVGEKILERDHWYFPCHFVKDQVMAGSLVSDGCSQMLKMYMIWLGLHLTTGPFDFRPVNGHPNKVRCRGQISPHKGKLVYVMEIKEMGFDEDNDPYAIADVNIIDVDFEKGQDFSLDRISDYGKGDLNKKIVVDFKGIALKMQKRSTNKNPSKVQPVFANGAATVGPEASKASS

SEQ ID NO: 41 - protein, 147 aa, Schizochytorium sp.
LNRRTDQGQYLDAVDIVSGSGKKSLGYAHGSKTVNPNDWFFSCHFWFDSVMPGSLGVESMFQLVEAIAAHEDLAGKHGIANPTFVHAPGKISWKYRGQLTPKSKKMDSEVHIVSVDAHDGVVDLVADGFLWADSLRVYSVSNIRVRI

SEQ ID NO: 42 - protein, 449 aa, Schizochytorium sp.
CTLGDLGDRSFMETYGVVAPLYTGAMAKGIASADLVIAAGKRKILGSFGAGGLPMHHVRAALEKIQAALPQGPYAVNLIHSPFDSNLEKGNVDLFLEKGVTVVEASAFMTLTPQVVRYRAAGLSRNADGSVNIRNRIIGKVSRTELAEMFIRPAPEHLLEKLIASGEITQEQAELARRVPVADDIAVEADSGGHTDNRPIHVILPLIINLRNRLHRECGYPAHLRVRVGAGGGVGCPQAAAAALTMGAAFIVTGTVNQVAKQSGTCDNVRKQLSQATYSDICMAPAADMFEEGVKLQVLKKGTMFPSRANKLYELFCKYDSFDSMPPAELERIEKRIFKRALQEVWEETKDFYINGLKNPEKIQRAEHDPKLKMSLCFRWYLGLASRWANMGAPDRVMDYQVWCGPAIGAFNDFIKGTYLDPAVSNEYPCVVQINLQILRGACYLRRLN

SEQ ID NO: 43 - protein, 407 aa, Aurantiochytrium sp. OH4
DTRIAVIGMSAILPCGTTVRESWEAIRDGIDCLSDLPEDRVDVTAYFDPVKTTKDKIYCKRGGFIPEYDFDAREFGLNMFQMEDSDANQTVTLLKVKEALEDAGIEALSKEKKNIGCVLGIGGGQKSSHEFYSRLNYVVVEKVLRKMGMPEEDVQAAVEKYKANFPEWRLDSFPGFLGNVTAGRCTNTFNLDGMNCVVDAACASSLIAVKVAIDELLHGDCDMMITGATCTDNSIGMYMAFSKTPVFSTDPSVRAYDEKTKGMLIGEGSAMLVLKRYADAVRDGDEIHAVIRGCASSSDGKASGIYTPTISGQEEALRRAYMRANVDPATVTLVEGHGTGTPVGDRIELTALRNLFDSAYGNEKEKVAVGSIKSNIGHLKAVAGLAGMIKVIMALKHKTLPATINVD

SEQ ID NO: 44 - protein, 332 aa, Aurantiochytrium sp. OH4
ALFSGQGAQYTHMFSEVAMNWPQFRESISDMDRAQAKVAGADKDYERVSQVLYPRKPYNSEPEQDHKKISLTAYSQPSTLACALGAYEIFKQAGFKPDFAAGHSLGEFAALYAADCVNRDDLFELVCRRARIMGGKDAPATPKGCMAAVIGPNAEKIQIRTADVWLGNCNSPSQTVITGSVEGIKKESELLQREGFRVVPLACESAFHSPQMQNASSAFKDVLSKVAFRQPSAQTKLFSNVSGETYSNNAQDLLKEHMTSSVKFISQVRNMHSAGARIFVEFGPKQVLSKLVSETLKDDPSIITISVNPSSGKDADIQLREAAVQLVVAGVN

SEQ ID NO: 45 - protein, 66 aa, Aurantiochytrium sp. OH4
VMEVLAAKTGYETDMIEPDMELETELGIDSIKRVEILSEVQAQLNVEAKDVDALSRTRTVGEVVNA

SEQ ID NO: 46 - protein, 230 aa, Aurantiochytrium sp. OH4
DVLLVSGGARGITPLCIREITRQVRGGKYILLGRSKVPAGEPAWCNGVSDDDLGKAAMQELKRAFSAGEGPKPTPMTHKKLVGTIAGAREVRSSIANIEALGGKAIYSSCDVNSAADVAKAVREAEAQLGARVTGVVHASGVLRDRLIEQKRPDEFDAVFGTKVTGLENLFGAIDMANLKHLVLFSSLAGFHGNIGQSDYAMANEALNKMGLELSDRVSVKSICFGPWDG

SEQ ID NO: 47 - protein, 284 aa, Aurantiochytrium sp. OH4
GNWTTPTKKVGSEPVVIHRKISAASNPFLKDHVIQGRCVLPMTIAVGCLAETCLGQFPGYSLWAIEDAQLFKGVTVDGDVNCEITLKPSQGTAGRVMIQATLKTFASGKLVPAYRAVIVLSTQGKPPAATTSQTPSLQADPAARGNPYDGKTLFHGPAFQGLKEIISCNKSQLVAECTFIPSSESAGEFASDYESHNPFVNDIAFQAMLVWIRRTLGQAALPNSIQRIVQHRALPQDKPFYLTLKSNSASGHSQHKTSVQFHNEQGDLFVDIQASVTSSDSLAF

SEQ ID NO: 48 - protein, 423 aa, Aurantiochytrium sp. OH4
RIAVVGMAVQYAGCKDKEEFWKVVMGGEAAWTKISDKRLGSNKRAEHFKAERSKFADTFCNENYGCVDDSVDNEHELLLKLSKKALSETSVSDSTRCGIVSGCLSFPMDNLQGELLNVYQNHVEKKLGARVFKDASKWSEREQSQNPEAGDRRIFMDPASFVAEELNLGPLHYSVDAACATALYVLRLAQDHLVSGAADVMLAGATCFPEPFFILSGFSTFQAMPVSGDGISYPLHKDSQGLTPGEGGAIMVLKRLDDAIRDGDHIYGTLLGATISNAGCGLPLKPHLPSEKSCLIDTYKRVNVHPHKIQYVECHATGTPQGDRVEIDAVKACFEGKVPRFGSSKGNFGHTLVAAGFAGMCKVLLAMKHGVIPPTPGVDGSSQMDPLVVSEPIPWPDTEGEPKRAGLSAFGFGGTNAHAVFEE

SEQ ID NO: 49 - protein, 429 aa, Aurantiochytrium sp. OH4
MRIAITGMDATFGSLKGLDAFERAIYNGQHGAVPLPEKRWRFLGKDKDFLDLCGVKEVPHGCYIEDVEVDFSRLRTPMTPDDMLRPMQLLAVTTIDRAILNSGLKKGGKVAVFVGLGTDLELYRHRARVALKERARPEAAAALNDMMSYINDCGTATSYTSYIGNLVATRVSSQWGFEGPSFTITEGNNSVYRCAELGKYLLETGEVEAVVIAGVDLCASAENLYVKSRRFKVSEQESPRASFDSGADGYFVGEGCGALVLKRESDCTKDERIYACMDAIVPGNMPAACMEEALAQARVNPKDVEMLELSADSARHLKNPSVLPKELTAEEEIRGIEAILSQRSSNEAVEPHNVAVSSVKSTVGDTGYASGAASLIKTALCLYNRYLPSNGASWEEPAPETQWGKSLYACQSSRAWLKNPGARRHAAVS

SEQ ID NO: 50 - protein, 516 aa, Aurantiochytrium sp. OH4
SRAWLKNPGARRHAAVSGVSETRSCYTVLLSDVEGHHETKSRISLDDDAVKLLVIRGDSHDAITQRVDKLRERLAQPSANVRLAFMELLGESIAQETKTPLPAFALCLVTSPSKLQKELELASKGIPRSLKMGRDWTSPSGSHFAPKPLSSDRVAFMYGEGRSPYYGIGLDIHRIWPELHEFVNAKTNKLWDQGDRWLIPRASTKEELKAQEDEFSRNQVEMFRLGILMSMCFTHIARDVLGIQPKAAFGLSLGEISMVFAFSEKNGLVSEELTTKLRNSEVWRKALAVEFDALRKAWNIPQDTPVSEFWQGYVVRGTREAVEAAIGPNNKYVHLTIVNDANSALISGKPEDCKAAIARLSSNLPALPVDLGMCGHCPVVEPYGKQIAEIHSVLEIPEVAGLDLYTSVNQKKLVNKSTGASDEYAPSFGEYAAQLYTVQADFPKIAKTVSDKNFDVFVETGPNAHRSAAIRATLGNSKPFVTGSMDRQNENAWTTMVKLVASLQAHRVPGVKVSPL

SEQ ID NO: 51 - protein, 449 aa, Aurantiochytrium sp. OH4
DLGSRAFMETYGVSAPMYTGAMAKGIASAEMVIAAGKRGILGSLGAGGLPIATVRKALEAIQAELPKGPYAVNLIHSPFDSNLEKGNVDLFLEKGVTVVEASAFMTLTPQLVRYRAAGLSRAADGSTVIKNRVIGKVSRTELAAMFIRPAPENLLEKLLKSGEITQEQAALARTVPVADDIAVEADSGGHTDNRPIHVILPLIVNLRDRLHKECGYPAHLRVRVGAGGGIGCPQAAIATFNMGAAFIVTGTVNQMSKQAGTCDTVRKQLSQATYSDICMAPAADMFEEGVKLQVLKKGTMFPSRANKLYELFVKYDSFESMAPGELERVEKRIFKKSLSEVWEETKDFYINRLQNPEKIERAERDPKLKMSLCFRWYLGLASFWANAGIPDRAMDYQVWCGPAIGSFNDFIKGTYLDPAVANEYPDVVQINLQILRGACFLRRLEAVRN

SEQ ID NO: 52 - protein, 152 aa, Aurantiochytrium sp. OH4
YKLCARKMLMIDRVTKIDYTGGPYGLGLLVGEKILERDHWYFPCHFVGDQVMAGSLVSDGCSQLLKMYMLWLGLHLKTGPFDFRPVNGHPNKVRCRGQISPHKGKLVYVMEIKEMGYDEAGDPYAIADVNILDIDFEKGQTFDLANLHEYGK

SEQ ID NO: 53 - protein, 147 aa, Aurantiochytrium sp. OH4
LSRRWNQCQYLDTIDLVVAGGSAGLGYGHGRKQVNPKDWFFSCHFWFDSVMPGSLGVESMFQLVESIAVKQDLAGKYGITNPTFAHAPGKISWKYRGQLTPTSKFMDSEAHIVSIEAHDGVVDIVANGNLWADGLRVYNVSNIRVRI

SEQ ID NO: 54 - protein, 449 aa, Aurantiochytrium sp. OH4
CSLSDLGDEGFMKTYGVVAPLYTGAMAKGIASADLVIATGKRKILGSFGAGGLPMHIVRAAVEKIQAELPNGPFAVNLIHSPFDSNLEKGNVDLFLEKGVTVVEASAFMTLTPQVVRYRAAGLSRNADGSINIKNRIIGKVSRTELAEMFIRPAPQNLLDKLIQSGEITKEQAELAKLVPVADDIAVEADSGGHTDNRPIHVILPLIINLRNRLHKECGYPAHLRVRVGAGGGVGCPQAAAAALAMGAAFLVTGTVNQVAKQSGTCDNVRKQLCMATYSDVCMAPAADMFEEGVKLQVLKKGTMFPSRANKLYELFCKYDSFESMPAAELERVEKRIFQCPLADVWAETSDFYINRLHNPEKITRAERDPKLKMSLCFRWYLGLASRWANTGEAGRVMDYQVWCGPAIGAFNDFIKGSYLDPAVSGEYPDVVQINLQILRGACYLRRLN

SEQ ID NO: 55 - DNA, 4671 bp, Aureispira marina
  CDS (1)..(4671)
atgaatttaaaccactcgcttcgcaaaactcctgttgctgtaataggaatgtctgcgctttttgctgatgctaaaactgttgaccaattctggaacaatatcatcactggcaaggatagcattacagatgttcctgaaaacagatggagaatagaagattactatgatcctgaccctagcgcaccagataaaacctactgtaaacgtggcggttttttacctaacattgattttaatccaatggaatttggcttgccacctaatattctggaagtaacagatgcctcccaactgttggcactgattgctgctagagatgcttttgaacaagctggttatggtaaagcttctgataaattcactgcagaactcaaagccagaacaggagtactacttggtgtagggggtggacaaaaattaattactccgcttacaggacgattgcaatatcctatctgggaaaaagcattaagagcttgtgggatagcagaaacagatatccctaatattgtagataaaatgaaaaaagcctacatcggctggaatgaaaattcgtttccaggtatgttaggtaatgttatttctggtagaattaccaatagatttgacttaggaggcatcaactctgttgtagatgcagcttgcgcagcttctttgagtgcggtaaaaatggctttgagtgagttggttgaaggccgtgcagatatgatgttaacaggtggtgtagatacagataattctccgttcatgtatctatccttctccaaaactcctgctttctccaaatcaaatgttattagtccttttagtgataaagcggatggtatgttgattggagaaggattaggaatgttggttctcaaaagattagaagatgctgaaagagatggagataccatttatgctgtagttaaaggtgtaggaacttcttctgatgggcgttttaaatctgtttatgctcctagaccttcaggccaagcaatggctatgaatcgagcctatgaagaagctggttttgaagcgaaaaccgtgggacttatagaagcacatggtacaggtaccaatgcaggagatgcctgtgaattaacctctatgggaatggtatttggtgctaataacgcacataaacaacatattgccctaggaacggttaaatctcaagttggccataccaaagctgccgctggtgctgctggacttatcaaagctgttttagcactacaccacaaagtcttgccacccactatcaatgtggagcaacctactgataaagtagatttatcccaatctcctttgtatatcaatacagaagctcgaccttggttaaccaatggtcaccctagaagagcaagtgtcagtgcttttggttttggtggtattaatgtacacttagctttagaagaatacaaaacaactcctcaacaagaaaattatagacttcaccagccttatcaaagtattttgttacaggcggctagtcctattcaattgcaagagttgtgtcaacaccatctaaccgccttacaaagtgaggaaaaagaaagagctttttgggctttagcacaaacagaacaaaaaacgcctacagcaactgccgctcgtttgggttttgttgctcaagatgcagcagaagcgatagcctttttagaattggctatacaacaattaaacagcaaaaccagcgcatggaatcatcctaagggattatattatgctcctaatgcagcatccactaagggaaaaatagttgctctattttctggccaaggctcccaatatgtaggcatgggaaaagaacttttaaatgcttttcctcctttgagagctacatttgatcagcaagaccaattaatgcaacaacaaaacagagcgcctttgtctgctactgtttatcctattcctgtttttaataaagaagcaaaagctcaacaacaaaaaaatctaacagcaacacagtgggcacaacctgcaattggtggctttagtatgggcttatacaaagtgctaaaacaagctggtttccatgctgattttgcagcaggacacagctttggagaactaacagctctttgggctgcgggagtatatgatgataagaccttcttacaattggcacaagctcgtggcgctgctatgggcaaagctaatccccaaggagatgcaggaactatgttggcggtaaaagcagggcaagctcaagtagaacaagctatcagtaacctacaaggcgttaaaatcgccaatgttaattctggtaagcaagtaattctgggcggaagcacggccgccatccaacaagctcaaacagctttgcaagcacaaggcttttccgttgtaccactacaagtatctgcggcttttcatacagaacttgtacaacatgcacaacagccatttgcacaaactgtacaaaattataatttccaagctcctcaaattcctgtttttgctaacagtaccgcacagccttatcctgctgcgcctgctgctatccaaaacatcttacaaggacaattattacaacctgttttattcaaacagcaaatagagaatttataccaagcaggtggtagaatatttgtagaatttggccctaaaagagtcttaacgaacttagttagtgatattctccaaaacaaagagcatcatgccattgctctaaatcctagtgctaagaaagatagtgatttgcaattccgccaagctattttacaactacaagtattaggtgtagagttaaataaagtagatccttattataaaacacctgctcaacctaccgctaaaaccaaaatgacagtgcccttaggtggacacaattatgtcagcaaaggtacacaaaaagcttactacgaagctcttaatgatggctaccagctttctactaccaccaatacggtagttcaagaaaaaattgtggaagttatcaaagaagttcctgtagaaaaaattgtagagaaaatcgtagaagtggaagtacctagctcttctacctccaattctaacaccaatcaatcagaagaagaagatattatgaacaaagagatcattgaaacattaaaagctactgtggaaatggtaaccgctcaacaaaataaatctctagaacttttccagagttttttgagtgagcaaaatcgccaatctcaaatgcttatccaagtcttggctcagcaaatcaatatagctgctcaaccacaagcgttagagaacaaaccaatgtacttgaaagaggataaaaaagctttagcagaacctaaagtagtgactgctcctaaagcggaacccactttccaacaagctcaggcacctaagccaacacctcaaacagtagcgacagctacagtagaaacgcctactgctactactgctgacaatggtctttctagacaaaaactagaaaatatcctgcttactgttatcagtgataaaacgggataccctactgaaatgctagagctagacatggatatggaagcagatttgggtattgattctatcaaaagagtagaaatctttggcgctatgaccgaagattatcctgaggtctctggtgttaatccacaggatttaactgaccttagaacactcggccaaattgttgactatttagtagaaaaagcaggcgctcccagtaacacaaccactacatctgctcctgtacaacaaacagctgctccacaaccgactccagctgccactactgctaacactaacaacggtctttctagacaaaaactagaaaatatcctgcttactgttatcagtgataaaacgggataccctactgaaatgctagagctagacatggatatggaagcagatttgggtattgattctatcaaaagagtagaaatctttggtgctatgaccgaagattatcctgaggtctctggtgttaatccacaagatttaaccgaccttagaacactcggccaaattgttgactatttagtagaaaaagcaggcgcttccagtaacacaaccactacacctgctcctgtacgacaaacggcggctccacaaccgactccaactgctactactgctagcaatggtctttctagacaaaaactagaaaatatcctgcttactgttatcagtgataaaacgggatatcctactgaaatgctagagctagacatggatatggaagcggatttaggaattgattctatcaaaagagtagaaatctttggcgctatgaccgaagattatcctgaggtctctggtgttaatccacaggatttaactgaccttagaacactcggccaaattgttgactatttagtagaaaaagcaggtgctactaataacacaaccactacacccgctcctgtacaacaaacggctgctccacaatcgactccagctgccactactgctaacactaacaacggtctttctagacaaaaattagaaaatatcctgcttactgttatcagtgataaaacaggctaccctactgaaatgttagagctagacatggatatggaagcggatttgggtattgattctatcaaaagagtagaaatctttggcgctatgaccgaagattatcctgaggtctctggtgttaatccacaagatttaaccgatcttagaacactcggccaaatcgttgattatttagaagaaaaagcggatactaaaaaaaaaatcctaagctaa

SEQ ID NO: 56 - protein, 1556 aa, Aureispira marina
MNLNHSLRKTPVAVIGMSALFADAKTVDQFWNNIITGKDSITDVPENRWRIEDYYDPDPSAPDKTYCKRGGFLPNIDFNPMEFGLPPNILEVTDASQLLALIAARDAFEQAGYGKASDKFTAELKARTGVLLGVGGGQKLITPLTGRLQYPIWEKALRACGIAETDIPNIVDKMKKAYIGWNENSFPGMLGNVISGRITNRFDLGGINSVVDAACAASLSAVKMALSELVEGRADMMLTGGVDTDNSPFMYLSFSKTPAFSKSNVISPFSDKADGMLIGEGLGMLVLKRLEDAERDGDTIYAVVKGVGTSSDGRFKSVYAPRPSGQAMAMNRAYEEAGFEAKTVGLIEAHGTGTNAGDACELTSMGMVFGANNAHKQHIALGTVKSQVGHTKAAAGAAGLIKAVLALHHKVLPPTINVEQPTDKVDLSQSPLYINTEARPWLTNGHPRRASVSAFGFGGINVHLALEEYKTTPQQENYRLHQPYQSILLQAASPIQLQELCQHHLTALQSEEKERAFWALAQTEQKTPTATAARLGFVAQDAAEAIAFLELAIQQLNSKTSAWNHPKGLYYAPNAASTKGKIVALFSGQGSQYVGMGKELLNAFPPLRATFDQQDQLMQQQNRAPLSATVYPIPVFNKEAKAQQQKNLTATQWAQPAIGGFSMGLYKVLKQAGFHADFAAGHSFGELTALWAAGVYDDKTFLQLAQARGAAMGKANPQGDAGTMLAVKAGQAQVEQAISNLQGVKIANVNSGKQVILGGSTAAIQQAQTALQAQGFSVVPLQVSAAFHTELVQHAQQPFAQTVQNYNFQAPQIPVFANSTAQPYPAAPAAIQNILQGQLLQPVLFKQQIENLYQAGGRIFVEFGPKRVLTNLVSDILQNKEHHAIALNPSAKKDSDLQFRQAILQLQVLGVELNKVDPYYKTPAQPTAKTKMTVPLGGHNYVSKGTQKAYYEALNDGYQLSTTTNTVVQEKIVEVIKEVPVEKIVEKIVEVEVPSSSTSNSNTNQSEEEDIMNKEIIETLKATVEMVTAQQNKSLELFQSFLSEQNRQSQMLIQVLAQQINIAAQPQALENKPMYLKEDKKALAEPKVVTAPKAEPTFQQAQAPKPTPQTVATATVETPTATTADNGLSRQKLENILLTVISDKTGYPTEMLELDMDMEADLGIDSIKRVEIFGAMTEDYPEVSGVNPQDLTDLRTLGQIVDYLVEKAGAPSNTTTTSAPVQQTAAPQPTPAATTANTNNGLSRQKLENILLTVISDKTGYPTEMLELDMDMEADLGIDSIKRVEIFGAMTEDYPEVSGVNPQDLTDLRTLGQIVDYLVEKAGASSNTTTTPAPVRQTAAPQPTPTATTASNGLSRQKLENILLTVISDKTGYPTEMLELDMDMEADLGIDSIKRVEIFGAMTEDYPEVSGVNPQDLTDLRTLGQIVDYLVEKAGATNNTTTTPAPVQQTAAPQSTPAATTANTNNGLSRQKLENILLTVISDKTGYPTEMLELDMDMEADLGIDSIKRVEIFGAMTEDYPEVSGVNPQDLTDLRTLGQIVDYLEEKADTKKKILS

SEQ ID NO: 57 - DNA, 2406 bp, Aureispira marina
  CDS (1)..(2406)
atgcctcaaccagattacctagacttcaccctcccttccacccatattgcccttcttacaaatgacggttctacgcttacacaagccgtgtacaaagcgctcttagccaaagggaataaagtagttgttctaaatttagcaggtatttctactcctttttctgagaatagcataagcttggccagtaactctgatgaagccatcaaagcagctatagctaccatcaaaaaccaatacggtactgtaggaacatttatacacctacacccacacttaacgttcagcaatcaccaatttgcacaacattttgacttagaaagagaccttctcaaaggaatcttcctcattgctaagcacattcaagcagatttaacagctttaggccaaaaacaaagagccaatttcttgacccttacacgattagatggaaaactaggtttagggaaaagaaataacacctctgtagtcggaggaggattaagtggcttggtaaaatgcttaaacttagaatggtcctctgtattttgtcgagccattgatgcccaaccagaatggtcagatgagcaattagctcaacagttaatgcaagaattacatgaccccaacagaggagtggttgaagtagcactttcagaggaaggcagagcaacgctaatagccaccaatgaccctgtaaaagcaggacaacatatcacaacagccgttacagagaactctgtattcttagtaagtggtggagcccgtggtgtgacagccaattgtgtgattgaaatggctaaagcctttcagtgtaaatttattttactaggaaggtcagatgccagtgtagaactcccagattttgccaaaaacgaaagtgaagaaggtgccctaaaaagagccattatgttagacatgaaggcaaaaggacaacaacctaacttagcagaagttaaaaaaatgtttaatagcattattgctaaaaaagaaattgaagacacccttcaagccattgagaaagcaggaggagaagccatatacatcaaaggtgatgtaaccaaagtctctagcgtcaagcctcaattactagcaatcacacaacaatggggaccaattacaggggtattgcatggagcaggaagattagcagataaatacattcaagataaaagtgagcaagatttcatcaatgtgctttctgttaaattggacggtttactaaccttgctacaatgtgtcaacctacaaaaattagaacatttgattctcttctcttctgttgctggtttttatggtaatgtaggacaaacagattatgccattgctaatgaaattctaagcaaagcagcccaccaattcagaaccaatcatccaaatacccaagtttctgccatcaattggggggcttgggatgcaggaatggtgagcgaagccctaaagaaaaaatttgaagcaatgggcgtttctttggttaatagcgtaggcggccctgctttattggtaaatgaacttaatgttgcttatgccaatcaaccacaggttattttgggcggcactctgcctgctgcgatttcctatacagaaggcgcattaacaactcatgaaatataccgaacattagaaccttctgagaatcctttcttacaacatcatgttattcaagggcaagccgttttgccagtggtaagtgctatgggctggatggcgactactgctgaacaaattttccctgattttagaacatttgaagtagccaatacaaagttattcaaagggctagtatttgatggtaatcaacctaaagctttcgtaactactttggtagaaaaagaaaaaaatgcttcgaccattgtactagaagcaaccattagcagccaagcacctaccgctaaattgcctacttttcactacaaagctacgcttacactaaaagccaaaaatttaggtttagaacaacctacctttgaagctactttaagcagtgattatacggctagttcaggtgcagttttgtatgagaatggcgccctttttcacgggaaacacttccaaggtattgaggagattttagattggaatgaacaccaaattgtcttaaaatgtaaagcacctcaagtttcaagagcagaacaaggccaattcccaatcttaggagtgaataccttctttgcagacattcaataccaagggatggttatttgggtacaaaaataccatgatggagccaaatctttgcctttagctacagaaagtgcgcaactctttgctcctgttccttttgacaaagaattattggttcatattgaaattgtagaagatactcctttcaaaatggtagccaactgcactacttatgatgctgatggaaaagtatatctatctactagaaatgctgctgttactgtttctaaggaactaacttggtag

SEQ ID NO: 58 - protein, 801 aa, Aureispira marina
MPQPDYLDFTLPSTHIALLTNDGSTLTQAVYKALLAKGNKVVVLNLAGISTPFSENSISLASNSDEAIKAAIATIKNQYGTVGTFIHLHPHLTFSNHQFAQHFDLERDLLKGIFLIAKHIQADLTALGQKQRANFLTLTRLDGKLGLGKRNNTSVVGGGLSGLVKCLNLEWSSVFCRAIDAQPEWSDEQLAQQLMQELHDPNRGVVEVALSEEGRATLIATNDPVKAGQHITTAVTENSVFLVSGGARGVTANCVIEMAKAFQCKFILLGRSDASVELPDFAKNESEEGALKRAIMLDMKAKGQQPNLAEVKKMFNSIIAKKEIEDTLQAIEKAGGEAIYIKGDVTKVSSVKPQLLAITQQWGPITGVLHGAGRLADKYIQDKSEQDFINVLSVKLDGLLTLLQCVNLQKLEHLILFSSVAGFYGNVGQTDYAIANEILSKAAHQFRTNHPNTQVSAINWGAWDAGMVSEALKKKFEAMGVSLVNSVGGPALLVNELNVAYANQPQVILGGTLPAAISYTEGALTTHEIYRTLEPSENPFLQHHVIQGQAVLPVVSAMGWMATTAEQIFPDFRTFEVANTKLFKGLVFDGNQPKAFVTTLVEKEKNASTIVLEATISSQAPTAKLPTFHYKATLTLKAKNLGLEQPTFEATLSSDYTASSGAVLYENGALFHGKHFQGIEEILDWNEHQIVLKCKAPQVSRAEQGQFPILGVNTFFADIQYQGMVIWVQKYHDGAKSLPLATESAQLFAPVPFDKELLVHIEIVEDTPFKMVANCTTYDADGKVYLSTRNAAVTVSKELTW

SEQ ID NO: 59 - DNA, 6726 bp, Aureispira marina
  CDS (1)..(6726)
atgaaaatagcaatcataggcttatctggtttgtttccaggctcttctactaatgaagaattttggcaaaatctcctagacgaaaaagacctaaccaatctagccaacttagaagattttggagctgaccctgcacttttttatgaagataaaaaaggagcagtagaccgatgttactccctccgaggaggttatatcagggattttgactttgaccctacaggctaccaattgtctgctgactttttggcccaacaagacaaattataccaatggtctttgtatgtcgccaaaacggccttagaagaaagtggctatgcccacaacaaagaagttttagcaaaatgtggcctaattctaggcaacctttctttcccaacaggatcttctcacaaattactagccgacttatataccaaaacaacagaaaaagcattacaagaattactagaagacaaaaacttcaaaatccctgctagtcagttacctattcctaataatgaggtcttggcagatacaccatctcaaatggtagccaaaggtttgggcttgggaggaggacactatgctttggatgcagcttgtgcaacatccttgtatgccatcaaactagcttgtgacgaattgattacagggaaagctgatttgatgttggcaggtgcggtttgtggctccgatcaactgtttatccacatgggcttttctattttccatgcctatgctcctcatggagaaaagtttgcacctctggataaagcatctggaggtttagtttcggcagaaggagctggaatggtggtcttaaaaagactagaggatgcagaaagagatggcgataatattttgggattgattggtggcattggtttgtccaatgatggcagtggcaaattcttattgagccctaatcctaaagggcaaagattagcttttgaaagagcttatgatttagaagaagtattaccacaaaatacctcctacctagaatgtcatgctacaggaacccccttgggagatgttacagaaatgaattccatttctgatttctttgcccaacaccaaaccaaacccttgctaggctctgtcaaatccaatatggggcatttactgacagcagcaggtatgtctggtttattcaaagtcctgctctccatgcaaaaagggattattcctcccaatatcaatttggaaagtgcagtacaagccaacaatcaatggattcaggatgagcaaattatcaaaaaaactactccttggaagggcgaccaagcaggtatcaattcctttggttttgggggaaccaatgcacacatggtcgttcaaaaacccaccagctcaacattaaaagaaaagaaagcgtaccaagcccaagaattgcttcctttagcaattgtaggcatggatgctcattttggtagttgtgagaatttagaagatttttatgctgctatttataatgggaaccaagatttcaaaccacttcctcccaaaagatggaaaggctttgatgctgatcaagatttgctaaaaagatatggctttaaggatggcttagctcctaaaggtgcctacattgaccaatttgatattgatctgttgaggtataaaattcagccaaaagaagcagaaacactagagccacaacaagccctcattctaaaagtagcagacaaagctttacaggatgctcaaatcagtcctagccaaaatattgctgtattaattgccatggaatctgaattggctattcatcattatttggcaagatgggatagtgtctggcaactcgacaaagcactggagcaaagtggtttatctttatctgaagaaaagaaaaccgccctcaaagaatacagcaaaaatgctttgtactttagagaaggtagccaaacccctagccagcatactagttttgtaggcaatattatggctagtagaattgctgctttatgggatttctctgggccggctttcaccgtttcttgtggtgacaatgcagtctttaaagccttggaagtagctcaaaatatactttctctaggagaagttgatgcagtagtagtcggtggggttgatttttgtggtggcttagaaaatgtcttattacgacaagaaaaagaagcgtctagccaaaatatagctcctagtctttctcttaaccaaggccaaaaaggttggttagtaggggaaggagcgggtgcagtcgttctaaaaagacaaatagatctacaaaaacaggataacgtctatgctgtgttagaacacattggccaagcttctgaacaacttaatgtagggtatcaagaactggttagcagtggctatgctgcacaagaccatcaggaattgaagcaattactagccacccaattggagcaaaagaccgctttaggttcggtaaaaacatcctttgggcatacgggcgcagccagtggcattgctgcacttattaaaacagctctttgcttacaccacaaattcattccaggcattcccaattgggaagcgcctcaagaagcaacggcctttgcaaaaaccaagtactattttcctatggcctctaggccttggttgctcaatgctggtgaaaagagaaaagcggcgattaatggcttagaagggttacaaattcatttgtcagaaggagtaaggtctagccccgctcctagtcctttgctacaaggaagagtaggaagtttgtttgtattaaaaggcaatactgaaacagcattaagagaagctttagctttgttattagaagacttggcagggaaatcttctttgcctgagttggcagctcgtctttattataaccatcaagcaaagcccagctcttatacgatagttctcttagcaaattctaagaaaaacctacaacaggaaatccgtttcatgcaagttggcttggaagctgctttgacagaaaacaaagtactcaaaacgcctaggggttcttattttacagcaaaacctctaggtaaaacaggaaaaatagcattttcttatcctggttctgcaacagcctatagaggtttagggcaagatatttttcaattgtttccttctttgcacgagcattttgggcaaaagctagaggatatagcagactttgtaggtagctcctatttgcatccaaaattacaaagccgtcaagaagaggctcctagcatccaaaccgatgcagtaagtatgatgtgtgcaggcgtattttcatctgctatttatacccacttactcaaagataaatttggattaaaaccagatttggcatttggttatagcatgggcgaaagtgcgggcatgtggtactcttttgatgtttggaatcctgataatacggctgtatttagaaattctgacttgtttgccaaccaattatcaggggatttacgcttgttggctgagacttggggaatttcttctgaagaagccaaagcacgatggattagtttgattctattggccgataaagaagccgttcagaatttagtagcacaagaagacagatgctatttaagctttatcaatacacctcaagaggtgattatttctggagataaagaagcttgcaatagagttgttcaacaattgggctgccctgcggtagaggttccttttcagaatgtcattcatcatgatttttgcaaaaaagtccaagaggaattgtatgacatgcatcactttccattagaaacacagcctaatatagacttttattctagtttgagcctcgctcctttaccaatggatagtggagttattgctcaaaattctacccaagtttgctttcaaccagtcgattaccctaccactattcaacaattgtataacgatggggctagaatttttatagaattaggcgcagggaatacctgtactcaatggacaagtagtattttgggacagcaagctcatttagcagttagctgtactcaaaaaggcaagccagaaggcactgccctcttacaagcattggcacagttactcagtcatggagtagcgctagatttgcaacctttgtttgcagctgatttgctagccccctcgccaagagcattttacaaagctattgtttctggtggagctagaatttttgattatttattacaaccccaaaccaaaaaacaatttgcaggagtaactaaaactgctcttgtgcaacaattagaacctgctcttgccagcaatagcagagaatattcctttacttcaactaaaacaactactgtggacacaacacaatcaattcctagtccaagccaaaaagtactactaggagaaaatggtttaaaattgcaggattttaatgatcctaaccatctccaaggaaagacgattatcttttctcaggaagatttggaagagtttgcaacaggcaaaattgctaaagtatttggagaggaatacagtatcattgacacgtacaaaagaagagtcatgttacctatggccccctacttattggttagtagagtaacaggcttagatgctaaaagaggagaatttaagccttctaccatgcaaacggaatacgatattccttataatgcttggtttactacagatggtcaaattccttgggcggtctctgtggagtcaggacagtgtgatttattattaatttcttatttgggaattgattttgaaaataaaggagacttagtttatagattactggattgtaccttgacttttgtggatgacttaccctttgagggccaaacgttgaggtatgatatttctattaattcatttgtaagaaatggtgacaacttactgtttttctttagttataattgttatgttgaggatagattagtattgaaaatgagaaatggttgtgctggtttctttaccgatgaacaactagaggaaggattaggtgtggtttattctaaggaagaactagaagccaaaaccaatgcaaaaaaacctgcctttacccctttattaaacaccaaaaaaacaagcttcagcaaagaagatttgcaccatttgatagaaggtaatatggagttgtgctttgatagccctgcttattttgccaatggtagaaatccttctttgagacttcctcccgagcaaattttgatgatagatagaattgtatctgtcgatttgaaaggaggtgcctatggcttgggttatgtaattgctgaaaaagatttagcacctgaggactggtatttcccttgtcactttagagatgatgaagtattggcaggttctctacaagcagaaggaggaggaaatttattgcgcttttttatgttaatgttagggttacaaagattaaccaaagacgctcgttatcaacctatttttgacttacctcaaaaagtaagatgccgaaaacaagttactccttctaaagatacaaaactagtttataagctagaagtaaaagaaattggcttagttccaaatccttatgttattgctgatttagaaattgtatctgatggggtaattacagttcattttgagaatttaggattacaactaagagaaaaagacaatccgagatatttggaacagcagaaaggtgtacacatctcccctcgttctaaagatgccttactcaccgagttggacattactaattttgcactcaacaacctatcggttgcttttgggcctgactttgcttgttatgatggaagaacagtttctagacagcctaacaccgatttacaactgatttctagagtcttaaaaattgaaggagaacgtctaaatttcaaacaaccttctactatttacgcagaatatgatgtcccagaagatgcttggtattaccaacaaaatgcgtctatgaccatgccttattcggtcttaatggaaattgcattacaaccctgtggattactaggagcctatttgggttctacgttgcctttctccgataagaatttattctttaggaacttggatggaacgggtgaaatgctagagctaccaatgggaacagactggagaggcaaaaccattcataacaaagctgtgttggcctcttctgtagccttaggaggaactgttttgcagaattatacctttgaattgagtatcgatggtcaagtattctacaaaggaaaatcttcttttggatttttccctgctgaagcattggctcaacaagtaggattagataatggtacagctgtagcgccttggtaccaacagcaaaatctagctcaaaaagattatatgagcatcaaactagactctttgtatggcaaaatgaagctcttcaaagctcctgctaataaaccacattaccatttatcaggtgagcagctttccttgctcaacaatctaaaaattgttaaagatggaggccaatatggcaagggctatatttatggccatcaagctattaacctctatgattggttctttacttgccacttctaccaagaccctgtaatgccaggctctctaggagtagaagctattttgcaagccatgcaaacctttgcattacaacaagatttgggtaaagattttaaatcacctagatttgtacaagtacctcagcatacaactgtttggaaatacagaggacaaattttgcaaggagttgaaaacatgcactgtgaagtacatttcaaaagcatagaaaagaaaggagagcaattggttattgttggagatgcttatttatggaatgaagatactagaatttatcaaattacggacttggctctaggtatagaagaagcttaa

SEQ ID NO: 60 - protein, 2241 aa, Aureispira marina
MKIAIIGLSGLFPGSSTNEEFWQNLLDEKDLTNLANLEDFGADPALFYEDKKGAVDRCYSLRGGYIRDFDFDPTGYQLSADFLAQQDKLYQWSLYVAKTALEESGYAHNKEVLAKCGLILGNLSFPTGSSHKLLADLYTKTTEKALQELLEDKNFKIPASQLPIPNNEVLADTPSQMVAKGLGLGGGHYALDAACATSLYAIKLACDELITGKADLMLAGAVCGSDQLFIHMGFSIFHAYAPHGEKFAPLDKASGGLVSAEGAGMVVLKRLEDAERDGDNILGLIGGIGLSNDGSGKFLLSPNPKGQRLAFERAYDLEEVLPQNTSYLECHATGTPLGDVTEMNSISDFFAQHQTKPLLGSVKSNMGHLLTAAGMSGLFKVLLSMQKGIIPPNINLESAVQANNQWIQDEQIIKKTTPWKGDQAGINSFGFGGTNAHMVVQKPTSSTLKEKKAYQAQELLPLAIVGMDAHFGSCENLEDFYAAIYNGNQDFKPLPPKRWKGFDADQDLLKRYGFKDGLAPKGAYIDQFDIDLLRYKIQPKEAETLEPQQALILKVADKALQDAQISPSQNIAVLIAMESELAIHHYLARWDSVWQLDKALEQSGLSLSEEKKTALKEYSKNALYFREGSQTPSQHTSFVGNIMASRIAALWDFSGPAFTVSCGDNAVFKALEVAQNILSLGEVDAVVVGGVDFCGGLENVLLRQEKEASSQNIAPSLSLNQGQKGWLVGEGAGAVVLKRQIDLQKQDNVYAVLEHIGQASEQLNVGYQELVSSGYAAQDHQELKQLLATQLEQKTALGSVKTSFGHTGAASGIAALIKTALCLHHKFIPGIPNWEAPQEATAFAKTKYYFPMASRPWLLNAGEKRKAAINGLEGLQIHLSEGVRSSPAPSPLLQGRVGSLFVLKGNTETALREALALLLEDLAGKSSLPELAARLYYNHQAKPSSYTIVLLANSKKNLQQEIRFMQVGLEAALTENKVLKTPRGSYFTAKPLGKTGKIAFSYPGSATAYRGLGQDIFQLFPSLHEHFGQKLEDIADFVGSSYLHPKLQSRQEEAPSIQTDAVSMMCAGVFSSAIYTHLLKDKFGLKPDLAFGYSMGESAGMWYSFDVWNPDNTAVFRNSDLFANQLSGDLRLLAETWGISSEEAKARWISLILLADKEAVQNLVAQEDRCYLSFINTPQEVIISGDKEACNRVVQQLGCPAVEVPFQNVIHHDFCKKVQEELYDMHHFPLETQPNIDFYSSLSLAPLPMDSGVIAQNSTQVCFQPVDYPTTIQQLYNDGARIFIELGAGNTCTQWTSSILGQQAHLAVSCTQKGKPEGTALLQALAQLLSHGVALDLQPLFAADLLAPSPRAFYKAIVSGGARIFDYLLQPQTKKQFAGVTKTALVQQLEPALASNSREYSFTSTKTTTVDTTQSIPSPSQKVLLGENGLKLQDFNDPNHLQGKTIIFSQEDLEEFATGKIAKVFGEEYSIIDTYKRRVMLPMAPYLLVSRVTGLDAKRGEFKPSTMQTEYDIPYNAWFTTDGQIPWAVSVESGQCDLLLISYLGIDFENKGDLVYRLLDCTLTFVDDLPFEGQTLRYDISINSFVRNGDNLLFFFSYNCYVEDRLVLKMRNGCAGFFTDEQLEEGLGVVYSKEELEAKTNAKKPAFTPLLNTKKTSFSKEDLHHLIEGNMELCFDSPAYFANGRNPSLRLPPEQILMIDRIVSVDLKGGAYGLGYVIAEKDLAPEDWYFPCHFRDDEVLAGSLQAEGGGNLLRFFMLMLGLQRLTKDARYQPIFDLPQKVRCRKQVTPSKDTKLVYKLEVKEIGLVPNPYVIADLEIVSDGVITVHFENLGLQLREKDNPRYLEQQKGVHISPRSKDALLTELDITNFALNNLSVAFGPDFACYDGRTVSRQPNTDLQLISRVLKIEGERLNFKQPSTIYAEYDVPEDAWYYQQNASMTMPYSVLMEIALQPCGLLGAYLGSTLPFSDKNLFFRNLDGTGEMLELPMGTDWRGKTIHNKAVLASSVALGGTVLQNYTFELSIDGQVFYKGKSSFGFFPAEALAQQVGLDNGTAVAPWYQQQNLAQKDYMSIKLDSLYGKMKLFKAPANKPHYHLSGEQLSLLNNLKIVKDGGQYGKGYIYGHQAINLYDWFFTCHFYQDPVMPGSLGVEAILQAMQTFALQQDLGKDFKSPRFVQVPQHTTVWKYRGQILQGVENMHCEVHFKSIEKKGEQLVIVGDAYLWNEDTRIYQITDLALGIEEA

SEQ ID NO: 61 - DNA, 1629 bp, Aureispira marina
  CDS (1)..(1629)
atgattactttttctggaataaaacagcagttgtattggaaaggctcgcctagagctatttcttttgatgctgcgggtatggagcaaaaattaaaaaacacccaagaacattgttttgtagtagaggattttgctgggcgagttggcatcgccaatgcaggagaattaactactgatagcaaaggcttacaagtattagccatggtcgcccctatgaccgcagagcaattgggagatgctacttttagaaaagattataagctaaaatatgcctataaaacaggagcaatggctaatggaattgcttccgaagatttagtaattgctatgggcaaagcaggtttgctaggctctttcggagctgcaggtctcattcctagtagagtagaacaagctattgataccattcaacaagccttgcctactcaaagctacgcttttaatttgattcacagtcccaatgagcctgccttagaggaaggagctgtaaaacactttttggccagaggagtgaacgttgtagaagcctctgcttttctcaacctaactcttaatattgtccattatagagttgcaggtttaagccaagatgaagaaggaaatgttattattgggaatcgagttattgctaaaatttctcgtcaagaggtagcccgccacttcatgcaacctgctcctcaaaaatacttggacaaattactagaagcaggcaaaataacgcctttgcaagctcaactagctgcccgagtacctatggctgatgatattacagtggaagcagattctggtggacataccgataatcgtccattggtagcgttattgccttctattattcgccaaagagaccaattacaagcccaataccaatttagtactcctatccgagtgggagctgctggaggaattggcacccctgaagcagccttgtctgcctttatgatgggagcagcctatgtggtaactggttcaatcaaccaagcatgtatagaggcaggtacttccgaacatgtaagaaaattattggctaatgttgcccaaacagatgtaatgatggctcctgcttctgatatgtttgaaatgggggtagaattgcaagtcctcaaacgtggaacattgtttggaccaagagcaaaaaaactatatgaatactacatgcagtacaattccattgatgaaattccagctgccgagcgtgagaagttagaaaaacaaacattcaagaaacccttagaagaagtatggcaaggatgtattagcttttttgaagagagagaccctagccaaattgagcgggctaaaaataatcccaagagaaaaatggcattaattttccgttggtatttgggcttgtcttctaactgggcaaatgctggtgttaaggaaagaattagcgatatgcaaatttggtgtggccctgcgatgggctcctttaacgattgggtaaaaggaacctacttggaagattaccaaaaacgtcaagcggcagaagttgcttggcatattatggaaggggcggcttatctttatagagtgcaagcattggccacccaaggtataaaacttcctttggaatgggcaaaatataatcccaatccagtccctaatttttctctagcaattagctag

SEQ ID NO: 62 - protein, 542 aa, Aureispira marina
MITFSGIKQQLYWKGSPRAISFDAAGMEQKLKNTQEHCFVVEDFAGRVGIANAGELTTDSKGLQVLAMVAPMTAEQLGDATFRKDYKLKYAYKTGAMANGIASEDLVIAMGKAGLLGSFGAAGLIPSRVEQAIDTIQQALPTQSYAFNLIHSPNEPALEEGAVKHFLARGVNVVEASAFLNLTLNIVHYRVAGLSQDEEGNVIIGNRVIAKISRQEVARHFMQPAPQKYLDKLLEAGKITPLQAQLAARVPMADDITVEADSGGHTDNRPLVALLPSIIRQRDQLQAQYQFSTPIRVGAAGGIGTPEAALSAFMMGAAYVVTGSINQACIEAGTSEHVRKLLANVAQTDVMMAPASDMFEMGVELQVLKRGTLFGPRAKKLYEYYMQYNSIDEIPAAEREKLEKQTFKKPLEEVWQGCISFFEERDPSQIERAKNNPKRKMALIFRWYLGLSSNWANAGVKERISDMQIWCGPAMGSFNDWVKGTYLEDYQKRQAAEVAWHIMEGAAYLYRVQALATQGIKLPLEWAKYNPNPVPNFSLAIS

SEQ ID NO: 63 - DNA, 660 bp, Aureispira marina
  CDS (1)..(660)
gtgcttcatttgctttatatcaactctgctgtggttcaagctacttatacattgacagagttattgttattattaccagattctgtgaaagagaggacacttcgctatcaacagccacaggatgcgtataattttgtattgggaaggttattattgcaacaagctttgttggaaaaggggggggcagcagaagaattggaggctatacaatatagttctaaccaaaaaccttggctgcctagcttgaattttaatattagccattcccaagaatgggtggcttgtgctttctctagtgagcaagctgtaggcttagatatagaagtaccaagaccccttaaaaaaactcatttcagacattgtttttctttgaaagaatgggatgaaattacagcagatgtggggatgcacactttttatcaatattggacagccaaggaggctgtgcttaaagcacaaggattggatttagggcatctcttagatatgaccatagtggatttgaaggaggtttatgttaagttgccacaagaaaatcaaattactcgttggcagttgcagcatttttctttggataatagccctgcttatgcttgtttatgtgctaagtttgtcaaagatttttctattaatttactagatgtagattctttattctag

SEQ ID NO: 64 - protein, 219 aa, Aureispira marina
VLHLLYINSAVVQATYTLTELLLLLPDSVKERTLRYQQPQDAYNFVLGRLLLQQALLEKGGAAEELEAIQYSSNQKPWLPSLNFNISHSQEWVACAFSSEQAVGLDIEVPRPLKKTHFRHCFSLKEWDEITADVGMHTFYQYWTAKEAVLKAQGLDLGHLLDMTIVDLKEVYVKLPQENQITRWQLQHFSLDNSPAYACLCAKFVKDFSINLLDVDSLF

SEQ ID NO: 65 - DNA, 7746 bp, Photobacterium profundum SS9
  CDS (1)..(7746)
atgggtgttaagcggagactcatgatgagccaaaccccgaaaaccacgtctgaatcgcaggaagatacgcgactcaataaacgtcttaaagacatgccaattgcgattgttggcatggcgagtatgtttgcgaattcccgttacttgaataagttctgggatcttatcagcgagaaaattgatgctattacagaagtgcctgaaactcactggcgcccagaagattattacgatgcaaacaaaagcacaccggataagtcttactgtaagcgtggtggctttatacctgaagttgatttcaacccaatggaattcgggcttccgcctaacattcttgagctaactgatacgtcacagctactttcactgatcgtagcaaaagaagtattggctgatgccaaacttccggaaacatacgaccgtgataaaatcggtattacccttggtgtgggtggtggtcagaagatcagtcaaagccttaacgctcgtcttcaataccctgttctcaaaaaagtattcaaaaacagtggtatcactgacgaagacagtgaaatgctgattaagaaattccaagatcaatacattcactgggaagaaaattcattccctggttcactgggtaacgttatttccggccgtattgctaaccgcttcgaccttggtggcatgaactgtgtcgttgatgcagcatgtgcaggctctcttgctgcattgcgtatggcattaagcgagcttgttgaaggccgcagcgaaatgatgattacaggtggtgtgtgtaccgataactcaccaaccatgtacatgagcttctctaaaacaccggcattcacgacaaacgaaacaattcaaccattcgatattgactcgaaaggtatgatgattggtgaaggtatcggtatgattgcgcttaaacgtcttgaagacgcagagcgtgatggcgaccgtatctattccgtgattaaaggtgttggtgcatcttcagacggtaaatttaagagtatttatgcgcctcgtcctgaaggtcaggctaaggcacttaaacgtgcttacgacgatgcaggtttcgcaccgcacacacttggcttacttgaagcccacggcacaggcacagcagcaggtgatgtggcagaattcagtggtcttaactctgtattcagtgaaggcaatgacgaaaagcaacacatcgcattaggttcagtgaaatcacagattggtcacactaaatcaacagcgggtactgcgggtctaatcaaagcgtctttagcactgcaccataaagtactgccgccaacaatcaatgtaaccagccctaaccctaaactgaatattgaagactcgcctttctacctcaatacacagacgcgtccatggatgcaacgtgtcgatggtacaccgcgtcgtgctggtgtcagttcatttggtttcggtggtacaaacttccacattgtattggaagaatacacaccagaacatgcacgcggtgacaaataccgtcagcgccaagtcgcacaaacgttattgtttagcgctgcgtctcgcgaagcactgattgctagcttaaaagagacatcagctaaccttgcaaacgatagcgtgaatcttgaaacactggctgaaagccatggtttacgcagcatcgaagtatcacatgcacgtttaggtctagctgttaaaacaggcgaagagctaaacacccagcttgctcaagcgatttcaaacctagaaagccaaactaaagcgcactggcagcttcctagtggcacaagctaccgcgaatcagcgcttgtaagcggcaatgattcagcaaaagttgctgcattgtttgccggtcaaggttcacagtacctcaacatgggccgtgagctagcgtgccattaccctgaaatgcgccaacagttagcgaaagccgatcaagtatttggtcagaataagaaaacagcactgtcacaggttctgttccctattccaatgttcaataaagaaagtacacaagcacaagaggctttactgactaataccgctaatgcacagagtgcaatcggtgtgatgtcgatgggccagtttgaactactaacgcaagcaggctttaaagccgacatggttgcaggtcacagcttcggtgagttaagtgccctatgcgcttctggtgttatctctcaagatgattactaccagcttgcttttgcacgcggtaacgcaatggcagcaacaccagcagaaggtgatagcggtacaatgtacgctgttattcttgacgctgataagctggcagatgttgaaaagtgcattagtgcatttgaaggcgtaagcattgctaattacaacgcaccaacacaactagttattgcgggccctaccgacagtgctcaacttgctgcaaaagcactaacagagcaaggcttcaaagcgattcctcttcctgtttctggcgctttccacacgccattagttgctcacgcgcaaaaaccttttgcagcagctattgataaagcaacgttcagcactccagcattgccgttgtattcaaatgcaaccggtgaactgcataagaacgatggcaaggccattaagaaagcgttcaagcaacatatgttgcaatctgttcgtttcagcacacagcttgaagctatgtatgatgctggcgcacgtgtctttgttgagttcggaccaaagaacattctacaaaagctcgttgagaagacgttaaccaataaagccgatgagctttgcacgatcagtattaacccgaaccctaagggtgatagtgatcagcaattacgcttagccgcagttcaactcgctgttgtcggtatctcgctagacaatatcgacccgtatcaagcagagattgcgccaccagcagcaacatcaccaatgaacatcaaactaaacgcagcgaattacatcagtccagctactcgtgcaaaaatggcgaagtcattaacaactggcgaagtaagcacaaaaactgaaatcgttgaaaaagtcgttgagaagattgtggaaaaagaagtgattaaaacggaaattcgtgaagtacccgttgctgcagcgccaacgcaggctgtaactgtacagtcaacagcacaagcagcgccacagccagtggtaacaacagcgccagctcaagttgttacacaagcaacgtcacaactgccagtcggcgaggcatcgttgcatgctttcttcagtgcacaacagcaggcagctgaacttcatcagcagttcttagcaattcctcagcaatacggtgatacgttcacggcattgatgacagaacaagctaaaatggcaacggctggtattgcgattccagaaagcctacaacgttcaatggagctattccaccagcaccaagctgaaacgttaaaagcacatgcccactaccttgaattacaagcaaacagcaataactctgcgttaggtatgttgacttcacaagcgcctgctcatcaggttcctgtttatcagacgccaattcagcaagtatcagtggctccggctcctgctgcaccagtagttacgccagtagttgctgcgccagtcgcgacacctacgccaattaaggctgttattcaaactcaacaatcagcgcctgtcgcttcagcaccaatcgcggcacctgttacacagacagttaaaccaacacctgttgttcaagcagctgtagcaccacaagcagcagttcaaactgcgaatccagaacaagttatgctggaagtggttgcggagaaaactggctaccctaccgagatgttagatcttgatatggatatggaagcagacctaggtatcgactcgattaaacgtgttgagattctaggtacagtgcaagaccaaatgccaaacctgccagagctaagccctgaagatttagcagagtgtcgtacactgcgcgaaatcgtgacttacatgaacagtaaaatgccagcagctgctgcatctgctccagtaacgtcagcatcaaacggcttagacgcagcacaagttcaaagcacaatgcttgaagtggttgcagataagacgggttacccaaccgaaatgcttgatctagaaatggatatggaagcagatttgggtatcgactctattaagcgtgttgaaattcttggtacggttcaagaccagctaccgacgcttcctgagttaagccctgaagatttggctgaatgtcgtacgctaggtgaaatcgtaagctacatgaacagcaagcttcctgcagcgtctgcagtagctgcacctgttgcttctgctccagtcgcgtcagcatcaaacggtttagacgcagcacaagtgcaaaccacaatgctagacgttgttgcagataagactggctacccaactgaaatgctagaccttgcaatggacatggaagcagatttgggtatcgactctatcaaacgtgttgaaattctaggtaccgtgcaagaccaactaccgggcttaccagaactgaaccccgaagatttagctgagtgtcgtacgctaggcgaaatcgttgattacatgaacagcaaattacctgctgtctctacacaaaatgtagcgattcaaacagctgctccagtcgcgtcagcatcaaacggtttagatgcagcacaagttcaaggcacaatgcttgaggtggttgccgataaaactggctacccagcagaaatgctagactttgcaatggacatggaagcagaccttggtatcgactcgatcaagcgtgttgaaattctaggtaccgtgcaagaccaactaccgggcttacctgagctgaaccctgaagatttagctgagtgtcgtacactgggcgaaatcgttgactacatgaacagcaaactaccagcagcctctacacaaaatgtagcggtacaaacagtagcagcaccagtagcaacggctcctgcaacaaacggcttagacgcagcacatgttcaaaacacgatgatgaatgtagttgccgataaaacaggttatccagcagaaatgctagaccttgcaatggacatggaagcagaccttggtatcgactctatcaagcgtgttgaaattctaggtaccgtgcaagaccaactaccgggcttgccagagcttaaccctgaagatttagcggagtgtcgtacactgggcgaaatcgttgcttacatgcaaagcaagctttctaatacttcagcagtagcagcaccttctgcacctgctgttgaaaaccttgtagaagcgattgcagaaacaagcaatgtagagcttcctcctcacagcgaggtggcgctaaaaaagttaccagcggtagataaattagtagactgtttttccaaagaagcttgtatcgtgattaccgatgatggtcacaatgcgggtgttctagcagaaaagttaagtgcaaacggccttcaagttgctgttgtacgtagtcctctatctgccgcgtcaccgttaaacagcgaaatcgcgagctacacattagcaagcattgatgacgctagtatcaaaactgttatttcagacattgagagcaagcaaaaagaaattggtggattcattcacttacagcctcttgcaaccgatgctaaaacagataaagcaacagctgtaacattgcatgcaacggcaaaagaaagcatttctatggctttcctattcgcgaaattgcttaaaactcagttaaacgcagcaaaaaaccgcagtgccttctttacggtaagtcgtattgatggtggctttggttacttgaatgcagaacaacttatcaatgcagaattgaaccaagcggcattatctggtttaacgaaaacattgagccacgaatggtcaacagtattctgtcgcgcactggatgttgcgccaacgcttgatgctcgtcatcttgcagaagcagtaacagccgaattattcgatatcgatactcacactgttgaggtgggtctggctgatgcgaataacggcgaatctggtcgagcaacactgattgcaaccaatgcaggtactgctctaacaaaaaatgcctcagcaaaactggacaagaacgataacgtgcttgtgactggcggcgcgaaaggcgttacgtttgaatgtgcattaacactggctaaacagtgcaaatcacacttcattcttgcaggtcgtagtcagcatattacggcaaacgaactgccagaatgggcacaaggtaaacaagcaaacgagctaaagccagcagccattcgccatattcaaacatctggtgagaaaccaacaccgaagaaagtagatgcgttactcaagcctgtattaagcagccttgaaattaacactgctctttctgcatttgctaatgtgggtgcgagtgctgaatacataagccttgacgtatcaagcagtgattctgttgctaaaacactgtctcagttcaatgatattacaggtcttattcacggcgcaggcgtactggctgacaagcatattcaagataaaacgcttgatgagttaaaccttgtttacggcactaaagtaggcggtcttgaagcagtgcttaacgcattaaacagcgacaagctaaaactggttgcgatgttctcatcagcagctggcttctacggcaacactggacaaagcgattacgcgatgtccaatgaaatattgaataaagcggcattacagctatctgcacgtaaccctgaagcaaaagtaatgagcttcaactggggaccgtgggacggcggcatggtaaacgcagcattgaagaaaatgtttactgaccgtggtgtatacgtgattcctcttcaagcaggtgctgaactattcagctctcagctgctaagtgaaacaggtatccaactgcttgtgggtacaagcatgcaaggttcagacaacaaggaagccgctgtaaaaaagcttgatgcggagtctatgctagtagcaaagagtccgctgaattcaagcattactgtaacacgcgatcttgacccgaaagcaatgcctttcatcaatgatcactgcattgccggtaacccagtgttaccgacagtgtgtgccattcaatggatgcgtgaagcagcagagcaactgttaggagcgaacgttactgttcgcgactacaaactgcttaaaggcgtgatctttgatacgaatgaaatacaaacgctcacattgacactgacgccagacgaaaaagcaacggatcaaatcaaagcattgatcagctgccaagatcgtcctcagtacaaagcgatgctggttgtagaacccgtaccagcaacacaagctaaaacctttgtagcgaattcaaatgaacccataacaacagctaaagccttatacagtaatggcaccctgttccatggcccaagactgcaaggtattacaacggttgaacgttttgatgatgctggtttgctcgcacagtgccagctaccaacagtggctgatacagactgtggcgcattcgttccaacccaacaccttggtggttgccagcctttcgctgaagactacttattacaagcaatgttggtgtgggcgcgcttgaagtacggggctgcaagtctaccttctgccattggtgaatttgtttcttatgaaccaatgcaagcgggtgataaaggttggttagaactcgacgtaattaaaaatacgacgcgttcactacaagctaatatctcgctttaccatcaagatggtcgtttaagtgctgttatgaaaagcgctaaagtaacgatcagtaaaagcctaaatgaggcatttttggtgaagtctgagccagagaaggagcttctgtcatag

SEQ ID NO: 66 - protein, 2581 aa, Photobacterium profundum SS9
MGVKRRLMMSQTPKTTSESQEDTRLNKRLKDMPIAIVGMASMFANSRYLNKFWDLISEKIDAITEVPETHWRPEDYYDANKSTPDKSYCKRGGFIPEVDFNPMEFGLPPNILELTDTSQLLSLIVAKEVLADAKLPETYDRDKIGITLGVGGGQKISQSLNARLQYPVLKKVFKNSGITDEDSEMLIKKFQDQYIHWEENSFPGSLGNVISGRIANRFDLGGMNCVVDAACAGSLAALRMALSELVEGRSEMMITGGVCTDNSPTMYMSFSKTPAFTTNETIQPFDIDSKGMMIGEGIGMIALKRLEDAERDGDRIYSVIKGVGASSDGKFKSIYAPRPEGQAKALKRAYDDAGFAPHTLGLLEAHGTGTAAGDVAEFSGLNSVFSEGNDEKQHIALGSVKSQIGHTKSTAGTAGLIKASLALHHKVLPPTINVTSPNPKLNIEDSPFYLNTQTRPWMQRVDGTPRRAGVSSFGFGGTNFHIVLEEYTPEHARGDKYRQRQVAQTLLFSAASREALIASLKETSANLANDSVNLETLAESHGLRSIEVSHARLGLAVKTGEELNTQLAQAISNLESQTKAHWQLPSGTSYRESALVSGNDSAKVAALFAGQGSQYLNMGRELACHYPEMRQQLAKADQVFGQNKKTALSQVLFPIPMFNKESTQAQEALLTNTANAQSAIGVMSMGQFELLTQAGFKADMVAGHSFGELSALCASGVISQDDYYQLAFARGNAMAATPAEGDSGTMYAVILDADKLADVEKCISAFEGVSIANYNAPTQLVIAGPTDSAQLAAKALTEQGFKAIPLPVSGAFHTPLVAHAQKPFAAAIDKATFSTPALPLYSNATGELHKNDGKAIKKAFKQHMLQSVRFSTQLEAMYDAGARVFVEFGPKNILQKLVEKTLTNKADELCTISINPNPKGDSDQQLRLAAVQLAVVGISLDNIDPYQAEIAPPAATSPMNIKLNAANYISPATRAKMAKSLTTGEVSTKTEIVEKVVEKIVEKEVIKTEIREVPVAAAPTQAVTVQSTAQAAPQPVVTTAPAQVVTQATSQLPVGEASLHAFFSAQQQAAELHQQFLAIPQQYGDTFTALMTEQAKMATAGIAIPESLQRSMELFHQHQAETLKAHAHYLELQANSNNSALGMLTSQAPAHQVPVYQTPIQQVSVAPAPAAPVVTPVVAAPVATPTPIKAVIQTQQSAPVASAPIAAPVTQTVKPTPVVQAAVAPQAAVQTANPEQVMLEVVAEKTGYPTEMLDLDMDMEADLGIDSIKRVEILGTVQDQMPNLPELSPEDLAECRTLREIVTYMNSKMPAAAASAPVTSASNGLDAAQVQSTMLEVVADKTGYPTEMLDLEMDMEADLGIDSIKRVEILGTVQDQLPTLPELSPEDLAECRTLGEIVSYMNSKLPAASAVAAPVASAPVASASNGLDAAQVQTTMLDVVADKTGYPTEMLDLAMDMEADLGIDSIKRVEILGTVQDQLPGLPELNPEDLAECRTLGEIVDYMNSKLPAVSTQNVAIQTAAPVASASNGLDAAQVQGTMLEVVADKTGYPAEMLDFAMDMEADLGIDSIKRVEILGTVQDQLPGLPELNPEDLAECRTLGEIVDYMNSKLPAASTQNVAVQTVAAPVATAPATNGLDAAHVQNTMMNVVADKTGYPAEMLDLAMDMEADLGIDSIKRVEILGTVQDQLPGLPELNPEDLAECRTLGEIVAYMQSKLSNTSAVAAPSAPAVENLVEAIAETSNVELPPHSEVALKKLPAVDKLVDCFSKEACIVITDDGHNAGVLAEKLSANGLQVAVVRSPLSAASPLNSEIASYTLASIDDASIKTVISDIESKQKEIGGFIHLQPLATDAKTDKATAVTLHATAKESISMAFLFAKLLKTQLNAAKNRSAFFTVSRIDGGFGYLNAEQLINAELNQAALSGLTKTLSHEWSTVFCRALDVAPTLDARHLAEAVTAELFDIDTHTVEVGLADANNGESGRATLIATNAGTALTKNASAKLDKNDNVLVTGGAKGVTFECALTLAKQCKSHFILAGRSQHITANELPEWAQGKQANELKPAAIRHIQTSGEKPTPKKVDALLKPVLSSLEINTALSAFANVGASAEYISLDVSSSDSVAKTLSQFNDITGLIHGAGVLADKHIQDKTLDELNLVYGTKVGGLEAVLNALNSDKLKLVAMFSSAAGFYGNTGQSDYAMSNEILNKAALQLSARNPEAKVMSFNWGPWDGGMVNAALKKMFTDRGVYVIPLQAGAELFSSQLLSETGIQLLVGTSMQGSDNKEAAVKKLDAESMLVAKSPLNSSITVTRDLDPKAMPFINDHCIAGNPVLPTVCAIQWMREAAEQLLGANVTVRDYKLLKGVIFDTNEIQTLTLTLTPDEKATDQIKALISCQDRPQYKAMLVVEPVPATQAKTFVANSNEPITTAKALYSNGTLFHGPRLQGITTVERFDDAGLLAQCQLPTVADTDCGAFVPTQHLGGCQPFAEDYLLQAMLVWARLKYGAASLPSAIGEFVSYEPMQAGDKGWLELDVIKNTTRSLQANISLYHQDGRLSAVMKSAKVTISKSLNEAFLVKSEPEKELLS

SEQ ID NO: 67 - DNA, 2076 bp, Photobacterium profundum SS9
  CDS (1)..(2076)
atgccattgcgcatcgctcttttagcccaagcagcagacgctgctgggctttctgccgatattctagcgtcattaccagcaattcaacatattgctattaatgacaacttcaatgccgcgcttcaaactgctattcaagcggtaaaccaaggtcagctagttcaacttaccctccaatgtaagccgaacgaaccacaacagcgtttactgatgcttagcggtttagctgctgctaaaaacaaaattcaccctcacgcgtaccttgcaggttttgctgaaggctctgttaatagcctagaaatagccctcaaccagtctcgtcgtcaaaatgccgatctcagtcatcaacaaacatctgaaacattagctgctgatcagcagtttctcgctttctttaacatggttgatgatattgctcgccggacactgcacgcggcagctcatgctgcaaacaatgcaagccattactggtttactgagccccataaagcacgcgtagctagtttaacgtttaatgccaattctgattcagaaagtagcttggtattaacgcaagcaacagggttacaaaaagcgcaatcattactgaacgcctctcgcttattctttgtcctctcagggctgaatgaaatagaattatcagtgcaattagaacagctaaagcaacgtttagctgatttacctaatgatttaacaccaaatgacaatgctgctcttattgctttaatgactaagaacttagcgcagtatcaaactgacgtttcgtcttctgccacttcatcgatatcactaccgactatcgtgttgcaaggcgcttctgttaccgctgttttgcaggaaatatctgcaatcagtaatgctttgccaaaagtaatagcagagaaaagtcattacaaaacaccagccggtagttgtttctcgcctgcacccaatagcaaaggtggtgtcacttttgtctacccaggtgttggtactgtataccctggcatgttccgtgattttcatcagtatttccccgcactttttgcacaactagagcgcgaaggaaacctgaaagaaatgctacaagccgaaaagacatacggtgaaaacccagccgaaatgacactcggtgaattggccattgccggtgttggtagcagctacttattaactcaattactctgcgaagagtttgccgttaagcctgatttcgctttaggttactctaaaggtgaagcatcgatgtgggcgagtttaggtgtgtggaaaaatccgcacgcattaatcgaactgacccaaacgagcccaatattcaccaccgctatttccggtaagctaaccgctgttcgtgaagcatggcaattaacagatgctgaagaaattacgtggaatagctttgttgttcgctgtgaatcagccaccattgaagcattgttgcctgaatttccgcgggcctatcttgctattattcaaggtgacacttgtgtattagctggttgtgaagcgacgtgtcgcgctttactcaaaaagcttggtaaacgcggcattgcagcgaatcgtgtaaccgctatgcacaccacaccagcgttaagtcagcattcacaagtcaccgagttttatactcagccattatgtgatgaactaccgatggatattaaattcatcagcgctgctgggctgttgcctcaaaatcaaaacgtgcctgttaatatcgatagccaaagtattgccaattccattgccgataccttttgcacaacactcgattttaccgctttgattcgcaccgctcgtgaacaaggcgcacgtttatttgttgaaattggtgccgacagacaaaccagtacgcttatcgataagataaaccgtacagataacgtaacaactgagagttgtactgtcgcggcgaatgcaaaaggcggcgaagatattgttactttgcttaaatgcattgcccagttaattacgcaccaaataccgctgtcactttctcccctgcttcaagggttagaagaacaagtgaatgcactgaaattacacagtgtatcgtcagcgaataccacaccgaacactacacaaggagagccagtgtga

SEQ ID NO: 68 - protein, 691 aa, Photobacterium profundum SS9
MPLRIALLAQAADAAGLSADILASLPAIQHIAINDNFNAALQTAIQAVNQGQLVQLTLQCKPNEPQQRLLMLSGLAAAKNKIHPHAYLAGFAEGSVNSLEIALNQSRRQNADLSHQQTSETLAADQQFLAFFNMVDDIARRTLHAAAHAANNASHYWFTEPHKARVASLTFNANSDSESSLVLTQATGLQKAQSLLNASRLFFVLSGLNEIELSVQLEQLKQRLADLPNDLTPNDNAALIALMTKNLAQYQTDVSSSATSSISLPTIVLQGASVTAVLQEISAISNALPKVIAEKSHYKTPAGSCFSPAPNSKGGVTFVYPGVGTVYPGMFRDFHQYFPALFAQLEREGNLKEMLQAEKTYGENPAEMTLGELAIAGVGSSYLLTQLLCEEFAVKPDFALGYSKGEASMWASLGVWKNPHALIELTQTSPIFTTAISGKLTAVREAWQLTDAEEITWNSFVVRCESATIEALLPEFPRAYLAIIQGDTCVLAGCEATCRALLKKLGKRGIAANRVTAMHTTPALSQHSQVTEFYTQPLCDELPMDIKFISAAGLLPQNQNVPVNIDSQSIANSIADTFCTTLDFTALIRTAREQGARLFVEIGADRQTSTLIDKINRTDNVTTESCTVAANAKGGEDIVTLLKCIAQLITHQIPLSLSPLLQGLEEQVNALKLHSVSSANTTPNTTQGEPV

SEQ ID NO: 69 - DNA, 6021 bp, Photobacterium profundum SS9
  CDS (1)..(6021)
atgcattgcccagttaattacgcaccaaataccgctgtcactttctcccctgcttcaagggttagaagaacaagtgaatgcactgaaattacacagtgtatcgtcagcgaataccacaccgaacactacacaaggagagccagtgtgagttctcaacacagtactgcttcccaaagcaataaaattgccattgtcggtttagcgaatcaatatcctgatgcggatacgccaaaggatttctggcaaaacctgctcgctaaaaaagattctcgcaccaccttgagccctgacaaattaggggctaaccctgatgcttatcaaggtatacaaggtgagtcagatcgcttttattgtgataaaggcggctacattcaaaatttctcttttgatagcaacggataccgtttgccagcagagacatttgaaggtttagatgaaagctttctttgggcactcgataccagccgcaaagccttggctgatgctggtattccattagatgacgctgtacttgaacgtacgggtgttattatgggtgccctatcgttcccgactaagcgttcaaatgacttatttctaccgatttatcactctgcggtagagaaagcattacaaaccaaactgggtaatgaacactttacattaaccccatcaaacgcaaatattactagccttaatcctgcgaacggttctgcggcacacaatgcgtctaggctcgttgccgatgcgcttggtttaggaagcgtacagcttagcctagatgcagcatgtgcaagttcagtctattctctgaaattagcctgtgattacctaaacacaggtaaagcagacatgatgttagcgggtgcggtatctggcgcagacccattcttcataaatatgggtttttcgatcttccacgcttaccctgaccatggtgtatcggttccattcgataccaacagtaaagggctttttgcgggtgaaggcgcaggtgttttaatactaaaacgtctagaagatgccgagcgtgatggcgataatatttatgccgttgttagcggtattggcttatccaatgatggtcgtggtcagtttgtactgagcccgaacagcaaaggacaagtccaagcattcgaacgcgcttatgaagcgacagatttatcgccagaaagtattgaagtgattgagtgccatgcaacaggtacacctttgggtgacaaagttgagatgacctcgatggagcgcttttttgcagacaaactaaacggctctcaagcgccgcttattggttctgcaaaatcgaatttaggtcacttactaacggctgcgggcatgcctgggatcatgaaaatgatctttgcaatgaaagaaggtgtattaccaccaagcattaacctttcaacgcccttatcatcacctgaaggtttattcggttcacacaccctaccgactcaagttcaagcttggccagacaaagcaggcaatactgaacgatgtgcaggtgtgtctgtctttggttttggtggttgtaatgcccacctattgcttgaagctcattcagctaactctgcaagaaatagccctgcagcgaatagtcctgcaaagcctgcagtttcagcaccattgaaagtaacaggtctagcgtcgcatttcggttcattaaaaaccattaatgcgctacataacgcgattacaacaggcgctgatgcctttgttgccctgccaaagaaacgctggaaaggcttagatcaacatccagagctactaagccagtttggattagatgcgattccacatggcgcatacattgatcagtttgagctggatttcttacgctttaaagtgccaccaaatgaagatgaccgcctaatttcacaacagcttttgttgatgaaagttgccgatgaagccattcgcgatgcaaagcttgaagtcggtcaaaaagttgctgtattggttgcaatggaaacggaactcgaaatgcaccagttccgtggccgtgtaaatttacatacccaacttgctgacagcctagaaaacatgggagttcagcttacagatagtgaataccaagcgcttgaagccattgcgatggatagtgttcttgatgctgcaaagctaaaccagtacaccagtttcattggtaacataatggcgtcgcgtattgcctcattgtgggactttaatggtccagccttcactatttcagcagcggaacaatctgttgcgcgttgtattgatgttgcgcaaaatctcatgtcgcaagaatcattagatgcagtcgttattgctgccgttgatttaagtggtagcgttgaacaaatcatccttaaaaacagcgttacacctgttgcattacatccgcaagatagcggctggaatgtgggtgaaggtgcaggagctatcgttcttgtcgatacggataacgcatcaactaaaaacagctacggtgaaatcaccgcgttagattttggttctgtcgctcaaagcaacatcactagcgatcgcctgttaacgactgcgggtattacagcaaacaacgtcagcctactagaactaaaccaagcgccagaaagtgttgagacggtgcagttcccactgccatctgctacacacattcaggctaatcaacgtttaggtcattgttacgcggcatcaggtatggcaagtattcttcatggcttattaagcctgaatgcaatacctaaacaaactacaataccaagcctcaacacctcggtaacggctgcggtaactaaagcggctatcgtggctaacgtcagcgaaaaccagtgttctcaactgttgttaacccaaaccagtaccgaaactcagtcattaaccgctcgtctaaatagcgaactggctaacgactcaaagcgtcaattaattaagcaagttacccttggtggacgtgatatttatcaacatatcgtgacagccgaactttctgacattcaacacattcagcagaaagtcgcgaatacgaagcctcttgttcaaaaacaaaacattaaacagcctcgcattcaagctattgctaaacccgttgctcaaccacagagcatcgcgcaaccaacagcaattccatcagtatccccgattctgacaacaccacgtcagacgccgattacaggtattcaaagcaatatgaccaatgtcctatccgctaaaaataagcatgatttaactgcattccaaagttctgcgtttgttgaaaaccaacaactcgctcaacaagttcatcaagcattccttcaaaaccgtgaacaaggcttgaagatggctgatgccttattaaaggcacaattgaacgaagtgactgctcaaatgaatgccgctactggtcaagtctttgatcaccagctagcaccttctccagcgctaacagaagcttcaacgtcagtgccagtgaatgtggctgcaacgccagctattgttaaccctattcgcaaaccttgtatctgggattacgaagatttagtagaatacgctgaaggcgatatcgccaatgtgtttggccctgactacgcagtgatcgataactactcacgccgtgtaagactgccaaccacagattatctgctggtatctcgcgtgacgaagcttgatgcaaccatgcttgaatacaaaccaagtacgatgacgacggaatacgatattcctgttgatgcgccatacttggttgatggtcaaatcccttgggctgttgcggtagaatcaggtcaatgtgacttgatgctaattagctacctaggtatcgactttgaaaacaaaggcgaacgtgtataccgcctattagattgtacacttaccttccttggcgacttgccacgtggtggtgatacgctacgttacgatatctctattaacaactttgcccgcaatggcgataccttgctgttcttcttctcttacgaatgtttcgttggcgataagatggtcctgaaaatggataacggctgtgcgggtttcttcactgatgaagagctgtcagacggtaaaggggttattcgtactgaagatgagatcaaatcaagaaacctagcggttaagcaacgttttaacccacttctgcattgccagaaaacacaatttgattatcagacactgcataacttgctagacgcaaatatcgcagggtgtttcggtgaaagtcatatttcagaccgtcatcaaccatcactgtgtttcagctctgataagttcatgatgattgaacaaattagccatgttgatccacaaggtggtacatggggactaggcctaatcgaaggtcacaagcaacttgaagcagatcactggtacttcccttgtcatttcaaagatgactcagtgatggctggctcattaatggccgaaggttgtggccagttactgcagttcttcatgatgtacttaggcatgcacacccaagtggaaaatggtcgattccaaccacttgaaaatgcacctcagcaagtacgttgtcgtggtcaggtgctacctcaatcagcagtgttaacttaccgcatggaagtaaccgagattggtttaagccctcgcccgtatgcaaaagcaaacattgatatcttgcttgatggcaaagtcgttgttgatttccaaaacttgggcgtgatgatcaaagaagaatcagaatgtactcgctaccttggttcatcagactttgattcagcaagcttagcttcatcaagctatgtagcagaaagtgcgccagctcaagcagacgttattacgcctgttgaagcacctatcagccaacaagcatcagcgaatgcgccgttaatggcacaaatacctgacttgaatacagcgccaaacaaaggtgttatccctcttcaacatattgaagcacctatcgtccctgattaccaaaaccgtacaccagacacagtaccgttcacaccgtaccatatgtttgagttcgcaacgggtgatattgaaaagtgtttcggtcctgatttctctatctatcgcggcatgatcccaccacgtacaccttgtggcgatctacagctaacaactcgtgttatcgaagttaacggcacacgtggcgattttaaaacaccgtcatcatgtattgctgaatatgaagtgccagaaaacgcctggtactttgatgaaaacagccacagcagcttgatgccatattcggtactaatggaaatctcattacaacctaatggcttcatctctggttacatgggtacaacacttggcttcccaggcttagagctgttcttccggaaccttgatggtagcggtaagatgctacgtaatgtcgacctacgcggtaaaactatcgtcaacgattcgcgtctactatctactgtaatgatgggtaccaacattgttcaaagcttcagcttcgaactcagtaccgacggtgtacctttctatgaaggcacggcagtatttggttacttcaaaggtgctgcactgaaagatcagcttggcctagataacggtcaagtcacctacccgtggcatgtcaataataaccgtacacctgacgtaagcattaacttactggataaagaaagccgttacttcaacgcgccactttcagcaacaggtgaagcacaaccgcactaccagttagctggcggccgtttgaacttcatcgataaagtcgatatcaccagtgatggcggtaaagccggcttgggttacttatatgccgagcgtactatcgacccgagtgactggttcttccaattccacttccaccaagatcctgtaatgccaggctcactaggtgtagaagccattattgaactgatgcaaacttatgccctaaacaaagatttaggtgctggtttccgttcaccgaagtttggtcaaattcaatctgaagtgaaatggaaataccgtggtcaaattaacccactgaacaagcaaatgtcattagatgtacacatcacagcgattaaagatgaagacggtaaacgtatcatcgtgggtgatgccaacttaagtaaagacggtctgcgtatttacgaagtgaaagacattgcaatctgtattgaagaagcctga

SEQ ID NO: 70 - protein, 2006 aa, Photobacterium profundum SS9
MHCPVNYAPNTAVTFSPASRVRRTSECTEITQCIVSEYHTEHYTRRASVSSQHSTASQSNKIAIVGLANQYPDADTPKDFWQNLLAKKDSRTTLSPDKLGANPDAYQGIQGESDRFYCDKGGYIQNFSFDSNGYRLPAETFEGLDESFLWALDTSRKALADAGIPLDDAVLERTGVIMGALSFPTKRSNDLFLPIYHSAVEKALQTKLGNEHFTLTPSNANITSLNPANGSAAHNASRLVADALGLGSVQLSLDAACASSVYSLKLACDYLNTGKADMMLAGAVSGADPFFINMGFSIFHAYPDHGVSVPFDTNSKGLFAGEGAGVLILKRLEDAERDGDNIYAVVSGIGLSNDGRGQFVLSPNSKGQVQAFERAYEATDLSPESIEVIECHATGTPLGDKVEMTSMERFFADKLNGSQAPLIGSAKSNLGHLLTAAGMPGIMKMIFAMKEGVLPPSINLSTPLSSPEGLFGSHTLPTQVQAWPDKAGNTERCAGVSVFGFGGCNAHLLLEAHSANSARNSPAANSPAKPAVSAPLKVTGLASHFGSLKTINALHNAITTGADAFVALPKKRWKGLDQHPELLSQFGLDAIPHGAYIDQFELDFLRFKVPPNEDDRLISQQLLLMKVADEAIRDAKLEVGQKVAVLVAMETELEMHQFRGRVNLHTQLADSLENMGVQLTDSEYQALEAIAMDSVLDAAKLNQYTSFIGNIMASRIASLWDFNGPAFTISAAEQSVARCIDVAQNLMSQESLDAVVIAAVDLSGSVEQIILKNSVTPVALHPQDSGWNVGEGAGAIVLVDTDNASTKNSYGEITALDFGSVAQSNITSDRLLTTAGITANNVSLLELNQAPESVETVQFPLPSATHIQANQRLGHCYAASGMASILHGLLSLNAIPKQTTIPSLNTSVTAAVTKAAIVANVSENQCSQLLLTQTSTETQSLTARLNSELANDSKRQLIKQVTLGGRDIYQHIVTAELSDIQHIQQKVANTKPLVQKQNIKQPRIQAIAKPVAQPQSIAQPTAIPSVSPILTTPRQTPITGIQSNMTNVLSAKNKHDLTAFQSSAFVENQQLAQQVHQAFLQNREQGLKMADALLKAQLNEVTAQMNAATGQVFDHQLAPSPALTEASTSVPVNVAATPAIVNPIRKPCIWDYEDLVEYAEGDIANVFGPDYAVIDNYSRRVRLPTTDYLLVSRVTKLDATMLEYKPSTMTTEYDIPVDAPYLVDGQIPWAVAVESGQCDLMLISYLGIDFENKGERVYRLLDCTLTFLGDLPRGGDTLRYDISINNFARNGDTLLFFFSYECFVGDKMVLKMDNGCAGFFTDEELSDGKGVIRTEDEIKSRNLAVKQRFNPLLHCQKTQFDYQTLHNLLDANIAGCFGESHISDRHQPSLCFSSDKFMMIEQISHVDPQGGTWGLGLIEGHKQLEADHWYFPCHFKDDSVMAGSLMAEGCGQLLQFFMMYLGMHTQVENGRFQPLENAPQQVRCRGQVLPQSAVLTYRMEVTEIGLSPRPYAKANIDILLDGKVVVDFQNLGVMIKEESECTRYLGSSDFDSASLASSSYVAESAPAQADVITPVEAPISQQASANAPLMAQIPDLNTAPNKGVIPLQHIEAPIVPDYQNRTPDTVPFTPYHMFEFATGDIEKCFGPDFSIYRGMIPPRTPCGDLQLTTRVIEVNGTRGDFKTPSSCIAEYEVPENAWYFDENSHSSLMPYSVLMEISLQPNGFISGYMGTTLGFPGLELFFRNLDGSGKMLRNVDLRGKTIVNDSRLLSTVMMGTNIVQSFSFELSTDGVPFYEGTAVFGYFKGAALKDQLGLDNGQVTYPWHVNNNRTPDVSINLLDKESRYFNAPLSATGEAQPHYQLAGGRLNFIDKVDITSDGGKAGLGYLYAERTIDPSDWFFQFHFHQDPVMPGSLGVEAIIELMQTYALNKDLGAGFRSPKFGQIQSEVKWKYRGQINPLNKQMSLDVHITAIKDEDGKRIIVGDANLSKDGLRIYEVKDIAICIEEA

SEQ ID NO: 71 - DNA, 1635 bp, Photobacterium profundum SS9
  CDS (1)..(1635)
atgacaacgcaaactatgaataatgaaaagctgtcgccatggccgtggcaggttgaagaaaacgcgacccactttgataacgctacaatggctaaaattttaaaagatttgagcctaggttgttacgtcgtgaatcaccctgaaaaaggggttggcattagccagcaggctgaaattacatctggtgatagcgcaagtgcaagccatgtacacccagtaagtgctttcgcaccagcattaggcacccaaagcttaggtgacaatgatttccgtcgtgtacacggtgttaaatatgcttactacgctggtgcaatggctaacggtatctcttctgaagagttagttattgcattaggtcaggcgggcattttatgttcgtttggtgccgcaggtctgattccttctcgcgtagagcaggcaatcaaccgtattcaagcagcgctgcctaatggcccttacgcgtttaacttgatccacagcccaagtgaacccgcactagagcgcggtagcgttgagctgtttttaaaacacaaagtacgtaccgttgaagcgtctgcattcttaggcctaacgccacaaatcgttcagtaccgtgcagcaggcttaagccgtgatgcacaaggcgagatcgttattgcgaacaaagtaattgcgaaagtaagccgtactgaggtggcgattaagttcatggaacctgcacccgctaagatgcttcaaggcttagttgatgaagggcgcatcactgcagaacaaatggaattagcccttctagtaccaatggctgacgatattactgcagaagctgattctggtggtcatacagataaccgtcctcttgttacgctattacctactattttagcgttaaaagaaacaattcaagctaagcaccaattcaaaacaccactacgtgtaggttctggtggcggtatcggtactcctgatgctgcactcgcagccttcaatatgggcgctgcttatattgtgacagggtcaatcaaccaagcttgtattgaagcgggagcaagtgaacatactcgtaaactgcttgcgactaccgagatggctgatgttgcaatggctcctgcggctgacatgttcgaaatgggtgtaaagctacaagttgtgaagcgcggtacattattcccaatgcgcgctaacaagctgtacgaaatttacacacgttacgattcaattgaagcgattccagcagacgaacgtcacaagcttgaaactcaggttttccattcaacgctagatgccatttgggaaggaaccgttgctcactttaacgaacgtgatcctaagcaaattgaacgtgcacaaggcaaccctaagcgtaagatggcactgattttccgctggtatcttggcctttcaagccgttggtcaaacactggcgaagcaggccgtgagatggattaccaaatttgggcaggtcctgctctgggtgcattcaatgcatgggcaaaaggcagttacttagataactaccaagatcgtcgtgctgttgatttaactaagcacctaatgcacggtgcagcttatcttgcacgcgttaacctacttgcagctcaaggtattcgcttaccagcagagcttgcacgttggaagcctgttgagaaaatgatttaa

SEQ ID NO: 72 - protein, 544 aa, Photobacterium profundum SS9
MTTQTMNNEKLSPWPWQVEENATHFDNATMAKILKDLSLGCYVVNHPEKGVGISQQAEITSGDSASASHVHPVSAFAPALGTQSLGDNDFRRVHGVKYAYYAGAMANGISSEELVIALGQAGILCSFGAAGLIPSRVEQAINRIQAALPNGPYAFNLIHSPSEPALERGSVELFLKHKVRTVEASAFLGLTPQIVQYRAAGLSRDAQGEIVIANKVIAKVSRTEVAIKFMEPAPAKMLQGLVDEGRITAEQMELALLVPMADDITAEADSGGHTDNRPLVTLLPTILALKETIQAKHQFKTPLRVGSGGGIGTPDAALAAFNMGAAYIVTGSINQACIEAGASEHTRKLLATTEMADVAMAPAADMFEMGVKLQVVKRGTLFPMRANKLYEIYTRYDSIEAIPADERHKLETQVFHSTLDAIWEGTVAHFNERDPKQIERAQGNPKRKMALIFRWYLGLSSRWSNTGEAGREMDYQIWAGPALGAFNAWAKGSYLDNYQDRRAVDLTKHLMHGAAYLARVNLLAAQGIRLPAELARWKPVEKMI

SEQ ID NO: 73 - DNA, 7596 bp, Shewanella oneidensis MR-1
  CDS (1)..(7596)
atgagccataccccttcacagcctcaaccttcaaccgataaaaaagccgataaaaggctaaataaacgcttgaaagatatgcccattgccatcgttggtatggcgagtatctttgcaaactcacgctatttaaataagttttgggatttaatttgcgacaagattgatgccattaccgacgtgccagccagccattgggcgattgatgactattacgacgtggataaatccaaggccgataaaagttactgcaagcgcggtggctttatgccagaggtcgacttcaatcctatggagtttggtctgccgcccaatattttggaactcaccgacagctcacaattgctttccctcgtcgtagccaaagaagtgctgcaggatgccaatctgccagacgattacgaccgtgaccgcatcggtatcacccttgggattggcggcgggcaaaagctaagccatagcctcaacgcgcgcctgcaatatcctgtgcttaaaaaagtatttaaaagcagtggcctgagcgatgaagatagcgagctgctgatcaaaaaattccaagaccaatatgtccactgggaagaaaactccttccccggctcccttggcaacgtgattgccggacgcatcgccaaccgtttcgatttaggtggaatgaactgcgtcgtcgatgccgcctgcgcaggatcgcttgccgccatgcgtatggcgctcaccgaactgaccgaaggtcgcagcgacatgatgatcaccggcggtgtctgtaccgacaactcgccttacatgtatatgagtttctcaaagacacccgcctttaccaccaacgagcaaatccaacccttcgatatcgactctaagggcatgatgattggcgaaggcatcggcatggtcgccttaaaacgcctcgacgatgccgagcgcgatggcgaccgtatttatgcggtaatcaaaggcgtaggcgcctcatcggacggtaaatttaagagcatttatgcgccgcgccccgaaggccaagccaaggcactagagcgcgcctatgatgacgcgggctttgcgccgcacactgttggcttgattgaggcccacggcacaggcacagccgcaggcgatgtagcggaatttactggtttaagctcagtgttttctcaggataacgcgcagttacagcatatcgccttaggctcagtcaaatctcaggtgggccacactaaatccaccgcgggcacggcgggtgtgattaaggccgcgctggcactgcaccataaagtattgccacccacgattaacgtcagcaagcccaatcctaagcttgagattgatcgctcgcccttttatctcaataccgaggcgcgcccttggatccaacgcagtgatgatacgccgcgccgcgctgggataagctccttcggttttggtggcacaaacttccatttagtactcgaagaataccgcccagatcacacgcgcgatgacgcctatcgtcaacgcagcgtggcacaaatcctactgtttgcggctaacgataaaaccttgctactgaacgagttaaaagctgttttacaacaagcaagctcagctaaggcggagctttctgaggcgcattttattcagtttgctaaaccctacgccctgcgagaaattacgccgcaatcggcccgtcttggctttatcgccaaagactatgcccagttacagactctgttaacccaagcgatagcgcagcttgaagccaataacgctgagagctggcaattaccttctgggatcagctaccgcgccaaggccttagtcaatgagcaaaccaagatcgccgcgctatttgctggtcaaggcgcgcagtacctgaatatgggactggagcttgccaataacttccccgagcttcgccgccatatccacgccagcgataaagtgtttagtacccatggtaagcctgcgctttcaagcgtgctctatcctattccagcctttgatgatgagtcgataaaagcgcaggaaacggcattaaccaacactctgtatgcccaaagcgccatcggcgcgctctcaatggcgcagtacgccctgtttactcaggcaggtttcgccccagatatgctggctggtcatagcttcggtgagctttcggccctgtgcgccgcaggggttatctcaatggatgactacatcaaacttgcctttgagcgtggacaggcgatggcgcagtcatcccaagataccgatgcgggtgttatgtatgcagtgatccttaagcaaaaacaagatattgaggtaatcaacggttgccttgcgcagtttgaaggcgtcaaagttgccaactacaactcacccactcagctggtgattgcaggcgctagtgccgccacccaacaggcggctaaggccattagcgagttaggctttaaggcgattgccctgcccgtttctggcgcctttcacacgccattggttgcccatgcacaaaagccctttagtgcagccatcgataaggctcagttcaacacgccaaagattgccttatatgccaatggcacaggccagctgcatcctatcgatgccaacgccatcaaagctgccttgaaagatcatatgttgcaatcggtgcactttagcgagcagctagaagccatgtatgccgcaggcgcacgggtgtttgtcgagttcggcccaaaaaacattctgcaaaagttaactgaaaataccctcgcggcgcagttaaacgagctgtgtattatcagcattaaccctaatcccaagggcgatagtgacagccaactgcgcagcgccgcagtgcaactggcggtggcgggggtaaaactccgcgagattgatccgtatcaagcagagttaattgccccagcagcaacatcggccatgaatataaaactcaatgccaccaactacatcagcccagcgacccgcagcaaaatggtcgattcgctgcaatcgggcaaaattaccagccaagtgcagtatgtggatcgcatcgttgaaaaagtggttgagaaagttgttgaaaaaccagtgattgtcgaaaaaattctagaaaaggttgtcgaagtggaaaagcccgtggcacaaaatagcaataatattcaacagcaaacgcctgcacagccagccagctttaccgctggacagacgaatcaagatgccctgagcgccttttttgccgcccaaacccaggcagcgcaattacatcaacaatttttggccattccgcagcaatacggcgatacagtcagcgcactgatggcagagcaagccaaaatggcaagccttgggatcgctattccagagagcctacaacgctcaatggaactgttccatcagcaccaagcgcaaaccctaaaaagtcatagtgactttatgcaattgcaaaccagcagtagccaagcagtactggcattattaggtcaaatgccagcgtctcaggttcaagcccccattcaagccgctgcaccagtggcagtagcagtgacaaaacctgtcgttccagcacaggcccccgtggttcaagggttggccgcagagcctaaagtgactgctgtgcctgtgagcgagcccacagttcagcaacctcaagtagcactggcacaagtagcacagacaaaagtaactcagccaccattagcgcaaccacaagtacaaactgtggccgcacaaaccagtgcgcttcaagtaaagcctgccttgcagcaaatcgagcacgctatgctctcagtggtggcagacaagaccggctatccggttgaaatgttagaacttagcatggatatggaagcggacttagggatcgactccattaagcgcgtagaaattctaggcacagtgcaggatgaattaccgaacctgccagaactcagcccagaagatttagccgagtgccgcaccctaggggaaattgtggcgctatttagccaagcagctcctgtaacatctgcgaccactgttagccatgctacacaaagtgccgtagccgcaagcgcggcggtttccaatgatgagattgagcgcactatgatggcggtcgtggccgacaagactggctatcccgttgaaatgctggaactcagcatggatatggaagccgaccttggcattgactccattaagcgcgtggaaattctaggcacagtgcaggacgaattacccaacctgccagaactgagcccagaagatttagccgagtgccgtaccctaggggaaattgtggcgctatttagccaagccgtcccagtggcagcacaaacctttgcagccatggcagcaacgaatcctcaggttgtcgcctctgccgtcacgccaattgcggccgtatccgatggcgagattgagcacactatgatggcggttgtggccgataaaaccggttatcccgttgaaatgctggaactcagcatggacatggaagccgaccttggaattgactccattaaacgggtggagattttaggcacggtgcaagataagctgccaaatctgccggaactcagcccagaagatttagccgagtgccgaaccttaggggaaattgcggcgctctttagccaagcggctcctgtaacagctgcggccacagttagccatgcgacacaaagtgcaatagctgcaagggcggcggtttctaatgatgaaattgagcgcactatgatggcggttgtggccgataaaaccggttatcccgttgaaatgcttgagctaagcatggacatggaagccgaccttggtatcgattccattaagcgcgtggaaattctaggcacagtacaagaccaactgccaaacttgccagaactcagcccagaagatttagccgagtgtcgtaccttgggtgaaattgtcgccctctatgctggttcgcaatcatcaagtgaggcgctacaacaaaaccatgctgcgacaattcaagagactcaagaggctattgcaaaaaccgtcgaggaaaccatcgacctgccgccccatagtgaggtgatgctaaaaaagttgccagcggcggctgagttagcgcgcatcatcgcaactagcgatgttcaactgacggcaaacagttacgtcgttatcggcgacgatggccacaacgcgggggtgattgccgaaaagcttcacgcccaaggtgttaaggtcgcggttgtacgctcacctaaaacggttgtgaccagcgcatcgccactcgatagccatattgccagcttcacgctggaggctattgatgatgaaagcatttgtgaggtcatcaatcagattgaagcgcttggccaaatcgccggttttattcatctgcagccacagcataaatccgttgccgataaaggtgctggcttagtgctggtagatgaagccaaagcttcggtcgagcaagccttcttgttcgccaaattcttacaaccgcttttaactgaacgtgactattgccgctttgtcaccgtcagctgtatagacggtggctttggctatatcggcatggacgagtcggtaggtgccctcatcagccagagtgaactcaaccaagcggcgctctttggactcactaaaaccttaaatcacgagtggccgggagtggtctgccgcgcgctggatatcgcgccaaacttggacgctaaaacggtcgccaatgcggtggtgcaggaatactaccttcaagatgcgccggtcgaagtcggtattgatagcaactttgatcgcgtgacattagttgcaggcaccgctgcacttcgccatccacccgccgtccttagcaatgcagataaaatactggtcacgggcggtgctaaaggtgtcacttttgaatgcgccttaagcttagcaaaacgctgtcaggcacattttttcctcgctggccgtagcgcccaccaagtgatccctgcatgggcagagggaaaaaagagcaacgaactcaaagccgcagccattgcgcacctgcaaagccttggtgataaacccacaccaaaacaagtggacgccttagtatggcccgtgcagagcagccttgagatcagccatgctttagccgcctttgatgccattggcgccagcgctgagtacttaagtgtggatgtcaacgaccctgcggccattgccagcaccattgcgcccattaacgcactatcgcctatcactgggattattcacggtgcgggagttctagccgataaacatattcaagacaagaccttaaatgaatttgaacgtgtctatggtactaaggtcaccgggcttaataatctgctgtcaacgctggatcttagccaagtaaaactgattgcactgttctcttcggcggcgggtttttacggcaataccggccagagcgactacgccatgtctaacgacattctcaataaagccgcgctgcaacttgcgcagcaattaccacaagccaaggtgatgagcttcgactggggtccttgggatggcggcatggtcaatccagcgctgaaaaaaatgtttattgaccgcggggtttatgtcattccactcaaagcgggtgccgagttatttgccagccaattattgagtgatacaggcgcacagctgttggtcggaaccgatatgcagggcaataccgccaatgccgttgaagttgcatcagcaaaaaagcctgaagcggatctagccacagcgttagatccgcagcctatggcccaaacggtgccgcagagcattcgcgtcatgcgcagcctcgaccctaaacgcatgagctttattgaggatcattgcatcaatggtcatgcggtgttgccaacggtatgcgccatcgattggatgcgtgaggccgccaaggcccatttaggtacggcggtgagtgtcagcgattatcgactgctcaagggagtaatcttcgatgaggcgctgcttgcacgcaatgcgcctattgagctcgaattgatgctcacgccgcttgctgacgctgcacaacaatcgactgaggcgttagccgcgctgataagctttgaaggtcgcccgcagtatcaggcggtgttagtggcgcagacggatgatatgccagacgcgcagcgtttcgaggttggcgagttgcattctctgatacaggagatggcacagcaacccgctatcgcgaaccgcgagtcgctctacagcgatggcaccttgttccatggcccgagactgcaaggcataagcgaagtgctcacctttgatgaccaacatcttatggccaaagtagaactgccacaggtggccttagacgactgcggcaagtttgcgccaaagcttgaggataagggtacacaaccctttgccgaagatctgttattgcaggccatgctcgtgtgggctcgccttaaatatcaagcggcaagcttacccagcacgattggcgagtttgtttcctatgcgcccttgagctttggtgaaaaggcagtattagtgctggatgtgcttaagcactcgtcccgctcgcttgaggcgaatattgccctctaccatcaggatggccgtttaagctgcgagatgaaacgagcaaaagtcacgatcagtaagacgcttaaccaagcatttttggctaataaacctcaacaactggcgcaagtgcaggcatcaatccaaaacatggccgaggtaagtgttaagtga

SEQ ID NO: 74 - protein, 2531 aa, Shewanella oneidensis MR-1
MSHTPSQPQPSTDKKADKRLNKRLKDMPIAIVGMASIFANSRYLNKFWDLICDKIDAITDVPASHWAIDDYYDVDKSKADKSYCKRGGFMPEVDFNPMEFGLPPNILELTDSSQLLSLVVAKEVLQDANLPDDYDRDRIGITLGIGGGQKLSHSLNARLQYPVLKKVFKSSGLSDEDSELLIKKFQDQYVHWEENSFPGSLGNVIAGRIANRFDLGGMNCVVDAACAGSLAAMRMALTELTEGRSDMMITGGVCTDNSPYMYMSFSKTPAFTTNEQIQPFDIDSKGMMIGEGIGMVALKRLDDAERDGDRIYAVIKGVGASSDGKFKSIYAPRPEGQAKALERAYDDAGFAPHTVGLIEAHGTGTAAGDVAEFTGLSSVFSQDNAQLQHIALGSVKSQVGHTKSTAGTAGVIKAALALHHKVLPPTINVSKPNPKLEIDRSPFYLNTEARPWIQRSDDTPRRAGISSFGFGGTNFHLVLEEYRPDHTRDDAYRQRSVAQILLFAANDKTLLLNELKAVLQQASSAKAELSEAHFIQFAKPYALREITPQSARLGFIAKDYAQLQTLLTQAIAQLEANNAESWQLPSGISYRAKALVNEQTKIAALFAGQGAQYLNMGLELANNFPELRRHIHASDKVFSTHGKPALSSVLYPIPAFDDESIKAQETALTNTLYAQSAIGALSMAQYALFTQAGFAPDMLAGHSFGELSALCAAGVISMDDYIKLAFERGQAMAQSSQDTDAGVMYAVILKQKQDIEVINGCLAQFEGVKVANYNSPTQLVIAGASAATQQAAKAISELGFKAIALPVSGAFHTPLVAHAQKPFSAAIDKAQFNTPKIALYANGTGQLHPIDANAIKAALKDHMLQSVHFSEQLEAMYAAGARVFVEFGPKNILQKLTENTLAAQLNELCIISINPNPKGDSDSQLRSAAVQLAVAGVKLREIDPYQAELIAPAATSAMNIKLNATNYISPATRSKMVDSLQSGKITSQVQYVDRIVEKVVEKVVEKPVIVEKILEKVVEVEKPVAQNSNNIQQQTPAQPASFTAGQTNQDALSAFFAAQTQAAQLHQQFLAIPQQYGDTVSALMAEQAKMASLGIAIPESLQRSMELFHQHQAQTLKSHSDFMQLQTSSSQAVLALLGQMPASQVQAPIQAAAPVAVAVTKPVVPAQAPVVQGLAAEPKVTAVPVSEPTVQQPQVALAQVAQTKVTQPPLAQPQVQTVAAQTSALQVKPALQQIEHAMLSVVADKTGYPVEMLELSMDMEADLGIDSIKRVEILGTVQDELPNLPELSPEDLAECRTLGEIVALFSQAAPVTSATTVSHATQSAVAASAAVSNDEIERTMMAVVADKTGYPVEMLELSMDMEADLGIDSIKRVEILGTVQDELPNLPELSPEDLAECRTLGEIVALFSQAVPVAAQTFAAMAATNPQVVASAVTPIAAVSDGEIEHTMMAVVADKTGYPVEMLELSMDMEADLGIDSIKRVEILGTVQDKLPNLPELSPEDLAECRTLGEIAALFSQAAPVTAAATVSHATQSAIAARAAVSNDEIERTMMAVVADKTGYPVEMLELSMDMEADLGIDSIKRVEILGTVQDQLPNLPELSPEDLAECRTLGEIVALYAGSQSSSEALQQNHAATIQETQEAIAKTVEETIDLPPHSEVMLKKLPAAAELARIIATSDVQLTANSYVVIGDDGHNAGVIAEKLHAQGVKVAVVRSPKTVVTSASPLDSHIASFTLEAIDDESICEVINQIEALGQIAGFIHLQPQHKSVADKGAGLVLVDEAKASVEQAFLFAKFLQPLLTERDYCRFVTVSCIDGGFGYIGMDESVGALISQSELNQAALFGLTKTLNHEWPGVVCRALDIAPNLDAKTVANAVVQEYYLQDAPVEVGIDSNFDRVTLVAGTAALRHPPAVLSNADKILVTGGAKGVTFECALSLAKRCQAHFFLAGRSAHQVIPAWAEGKKSNELKAAAIAHLQSLGDKPTPKQVDALVWPVQSSLEISHALAAFDAIGASAEYLSVDVNDPAAIASTIAPINALSPITGIIHGAGVLADKHIQDKTLNEFERVYGTKVTGLNNLLSTLDLSQVKLIALFSSAAGFYGNTGQSDYAMSNDILNKAALQLAQQLPQAKVMSFDWGPWDGGMVNPALKKMFIDRGVYVIPLKAGAELFASQLLSDTGAQLLVGTDMQGNTANAVEVASAKKPEADLATALDPQPMAQTVPQSIRVMRSLDPKRMSFIEDHCINGHAVLPTVCAIDWMREAAKAHLGTAVSVSDYRLLKGVIFDEALLARNAPIELELMLTPLADAAQQSTEALAALISFEGRPQYQAVLVAQTDDMPDAQRFEVGELHSLIQEMAQQPAIANRESLYSDGTLFHGPRLQGISEVLTFDDQHLMAKVELPQVALDDCGKFAPKLEDKGTQPFAEDLLLQAMLVWARLKYQAASLPSTIGEFVSYAPLSFGEKAVLVLDVLKHSSRSLEANIALYHQDGRLSCEMKRAKVTISKTLNQAFLANKPQQLAQVQASIQNMAEVSVK

SEQ ID NO: 75 - DNA, 2367 bp, Shewanella oneidensis MR-1
  CDS (1)..(2367)
atgacactcaacccaatcgcacatgccgcattaagcaatgcggcattaaacagtccgcatcccaatgccaaaccactgcgaatagccgtatggcttggtgatgggtggatgcaaagtgcacttagccatgcacaaaccgatgccagtgcgctgcagcagttgatggcttgtcgaattcagctcaatgttgaagataagctactgattgatgagccatctgatgagccatctgatgagtcaaccttagtcgccttactcagcgagcagctcgcccatattgcgcaaaaacaactcgttgaaatccgctttgaatatcaacagcaagttcgtagtctgtttctgctcgatggactacttgccgcgcaattacacctgcatgccgaggcttatatttcagccttggcacagactcaagccgaagcgaatgaagcactctgcgatatagaaatcgaaaactgtacaaatcgcgcttttgccctcgccaaacgcgattgtgctcaggcggttaattgctactcggatgcaggcaatcttgccagtcagctaaagcttttatatcaagctattgaggcgttaagtcatcgaacgctagcaggtattacgccaatgcttgcccacctcaatacagaaaaaacagagcgatgttattggttctccaagccccatcaagcaagggtgttaagcctaaatctcttcgataaagcccctcaagctcagacagcccaaagccttatcttgactcaaggtacagggcttatcgctcaaccgttgctcaatgccaacaggctgtttattcccatcagcggcaatgagtttgagtcgttaacgcttaagttgttgcaactgattgattcattgaccttatcgttaaaccaacctgatacggattggctcagcagccaaggcagtgattggtttaagcgctatcaagcaaaggatgaattagccttagtgctgatggcaggctcccttgaagagttaatgcaagaagccaaagcgatgcagacttttattgaaaaggcacgactgactattgagtccagcgcatccaagcacagtgcatccaagcctagtgcatcgacaagtttggtatttaaaaccccagcgggcagttattttgcggcctcgccccttggtgataagggcttaaccttcgtctatcccggcgtaggcactgtttacccgaatatgttcagcgacttacatagctatttccctgagctttatcgcgagcttgaacgcgaaggggatttagccgccatgttgcaggccgagacgatttaccaagacgcggcttatgcgaaaaccgcagttaatgtaagcgtaaaagacaccgcagaaatgagcttaagccagctcgccattagcggcgttggtgcgagttacctttttagcaagttattgactggcgtctttactatccaaccacggctcgcactgggctattccatgggtgaagcagccatgtgggcaagtttagctatctggcaaacaccccacagcctgattgatgccacccaaggcagcgcaattttcaaccacgaaatctccggtaaacttcaagccgttcgccgcgactggcaattgaatgaagatgctccgctggcgtggaatagctttttagtgcgcgcaaccagtaccgaaattaatccactgctggctgattttccgcgggtttatctggccatcgaacagggcgatacctgtattctcgcgggctgcgaagcaagctgcttacagctccttgcaaggctgaataagcgtggcattgccagcaataaagtgacggccatgcatactgcgccttcgcagtcacagcgcaatgcaatccaagggttttataccttaggcttaaaggccacagcctgcgagactcaggttcgttttattagcgcggcgcagcatagccccgtcaatattgatagcatgagtattgccaaaagcattgccgataccttttgcgcgccgctgaattttaccgcgctgattaacaccgcgtataaccaaggtgcgcgcttatttgttgaggtgggcgccgatcgtcaaaccagcacccttatcgataaaatcagccgccaacttgagttgggcgccgatggtgttcaagaaccgatattagccatggcatgcaatgccaagggcagcgatacgatcgtcagtttgctcaaatgcttagctcaacttatcagccatagagtgccactctccctggcggcacttatgcctcaatcggcagctcaatcagcaacgcactcagcaactatccatgcggataagactgcggctaaaacgatagcgtcacactctgccaacgcctgcgcattaggccattattcaaacgtattccaagaaggagaacccctttga

SEQ ID NO: 76 - protein, 788 aa, Shewanella oneidensis MR-1
MTLNPIAHAALSNAALNSPHPNAKPLRIAVWLGDGWMQSALSHAQTDASALQQLMACRIQLNVEDKLLIDEPSDEPSDESTLVALLSEQLAHIAQKQLVEIRFEYQQQVRSLFLLDGLLAAQLHLHAEAYISALAQTQAEANEALCDIEIENCTNRAFALAKRDCAQAVNCYSDAGNLASQLKLLYQAIEALSHRTLAGITPMLAHLNTEKTERCYWFSKPHQARVLSLNLFDKAPQAQTAQSLILTQGTGLIAQPLLNANRLFIPISGNEFESLTLKLLQLIDSLTLSLNQPDTDWLSSQGSDWFKRYQAKDELALVLMAGSLEELMQEAKAMQTFIEKARLTIESSASKHSASKPSASTSLVFKTPAGSYFAASPLGDKGLTFVYPGVGTVYPNMFSDLHSYFPELYRELEREGDLAAMLQAETIYQDAAYAKTAVNVSVKDTAEMSLSQLAISGVGASYLFSKLLTGVFTIQPRLALGYSMGEAAMWASLAIWQTPHSLIDATQGSAIFNHEISGKLQAVRRDWQLNEDAPLAWNSFLVRATSTEINPLLADFPRVYLAIEQGDTCILAGCEASCLQLLARLNKRGIASNKVTAMHTAPSQSQRNAIQGFYTLGLKATACETQVRFISAAQHSPVNIDSMSIAKSIADTFCAPLNFTALINTAYNQGARLFVEVGADRQTSTLIDKISRQLELGADGVQEPILAMACNAKGSDTIVSLLKCLAQLISHRVPLSLAALMPQSAAQSATHSATIHADKTAAKTIASHSANACALGHYSNVFQEGEPL

SEQ ID NO: 77 - DNA, 5892 bp, Shewanella oneidensis MR-1
  CDS (1)..(5892)
atgagttctcaaatgcatactcacccgactctgcaagacagcgccgctgtgccaaacgaccagcgccaaacgttaaaggcgatgccaaagattgccattgtcggccttgctgtccagtatcccgatgccgacacaccggagcagttttggcaaaatctgctggataaaaaagattcccgcagccaaatcgacgcggccaaactcaatgccaatcctgctgattaccaagggattcaaggccaagccgaccgtttttactgcgacaagggcggctatatccgcaactttcgttttgatccacagggttatcagttactgccagccacttttgcagggctggatgaaagctttttatgggcattagattgcagtaaaaaggccctactgaatgcgggcgtggatttaacggcgccattacttgagcgcacagggattgtgatgggcacgctctccttcccgacggctcgctccaatgaattatttttaccgatttaccatcaagcggttgaaaaggcattaaaaaccaagcttaatcaaccacaatttgccttagcgcccttcgccaatgcttcaattgcgggctcgcaactggcagccaatggtgtcattgctcatacggcgtctaagttgttaagcgatgccctcggccttggcggcgcacagctcagtctcgacgccgcctgcgccagctcagtctatgccctcaaattggcctgcgattatttaaccacgggcaaggccgatatgatgctcgcgggcgctgtatcgggcgccgatcccttctttatcaatatgggattctcgattttccacgcctatccagaccatgggatttcggcgcctttcgatagcaatagcaaaggcttattcgcgggcgaaggcgctggcgtattagtgcttaagcgtttagaggatgccgagcgcgatggcgataatatctatgctgtggtcagtggcattggtttatcgaacgatggcaaaggccaatttgtcttaagccccaacagtaagggccaagtgcaagccttcgagcgcgcctatgccgccgctaacacgcacccgagcaatatcgaagtgattgaatgccatgccaccggcacgccgctgggggataaagttgagctcacttcgatggagcgttttttcgaggataaactcgacggcactaaagcgccgctgataggttcggccaaatccaatcttgggcatttgctcaccgcagccggcatgcctgggataatgaagatgatttttgccatgcgctcaggccatctaccgccaagtatcaatttaacggcgccgatttcatcacctaaagggttgtttagcgtcaataatcttcccacacagcgtcaggcttggcccgataaagcgggcaacgatcgtcgccatgcaggggtgtctgtatttggttttggcggctgtaacgcccatctgttgttggaatcctatcaaccgacagcgcacagcgccgagaagcaagccaacaaacctgtttatcagcagcaagcattaaccgttataggcatggcgtcgcattttgggcctttggcctccatcaatgcgctggataaggcgctaatagcccaaacggatgcctttatcccgctgccccctaaacgatggaaaggcttagataaacaccccgatatcttgcagcaatttggcctaaatcgcgcgcccaaaggcgcctatatcgagcagtttgacttcgactttttgcgctttaaagtgccgcccaatgaggatgacaggcttatctcccagcaattgttgctgatcaaagtcgccgacgaagcgattcgcgatgccaagttaaccgcaggcagcaaggtcgcggtgttagtggcgatggaaaccgagcttgagctgcaccaattccgtggccgggtgaatttgcacacccaactggcggatagcttaaagaaacaaggtgttcacctctccaatgatgaatacctcgccctcgaagccatcgccatggacagcgtgctcgatgccgccaagctcaatcaatacaccagctttattggcaatattatggcgtcgcgcatcgcctcgctgtgggactttaacggcccagcgtttaccatttcagccgccgagcaatcggttgcccgttgtatcgatgtggcgcaaaacttactgtccaaagaggccctagatggcgtagtgattgccgccgtggatttaagcggcagtgttgaacaggtcatattgaaaaacgctcaagtcgccgttgatctcgatgccaacagcgcaaatccacagtggaaggtgggtgaaggcgccggcgctatcgtgcttacaaaccagcaagcgagcaacagtcaacaagcgggttacggccaaattcgtggtcaagcatttggcacaaaccatcagctgcctaagctgcttgattcgctgataaccgaaacggctatcgccaatccttcaatgccaacggccatccatatgattgagcaatgtattgccccagaagaacaactgccagcagagcatttattagcgcagcttaatcttttggggacgtcatgcaatcgagtcgccaatacccttggacataactttgccgctgcaggtatggccagtcttctgagtgccctgttaagcctaaagaacaggtcagcaaattcggataaaaacgccgaaaaacaggcattagtgtctacccaaagccaaggggtgagctcgctgctgctgttaagccaaacggcaacgcaggcggcacaactagaactgcgccttgcgcaggacttaaccttaagtgagcaaaaacatttaatcaaaccagtgacgctcggtggtcgcgatatctatcaacatattgtagatacgccgctgcctgcacttgccgccatccaaggcaaaatgcgccagttgcagcctttagcctcacaggcgacacaaactaagcccgcagtgggcgcagcacttgatatcacggctgaaaacgccacaccattagcagcagagagcggtatgtcatctaacgcaccacttcaatttgagacaacagcatcggcgcaggatagcgcggcattgttgcaaaaccagcaactcgcccgcgaggcgcacttagcctttttacagagccgtgagcaagggctcaaactggcagatgcgttgttaaaggcacaattatcccagacgacacaaatgggtgctgttgcagcccatgttgccaccagcgcaaatgtcgctgaaacgaaggcgcagcaagcggtgtcaatcccagaactcatgcctaatcatgcgcctaatcatgcaagagtcccgccctatacgccccccattcctgccgctaagccctgcatttggaactatcaggatctggtggaatacgccgaaggcgacattgccaaggtctttggcgccgattatgccattatcgacagctacgcacggcgcgtgcgcctgccgacctcggattatctgctggtctcgcgggtaacgaagctcaacgcgcaaatgaaccgctatcaaccgagcagtatgaccacagaatacgatattcccgtggatgcgcccttcttggtcgatggccaaattccttgggcagtggcggtcgaatcgggccagtgcgatttaatgctgatcagctacttaggtatcgattttgaaaacaagggcgagcgcgtctatcgtttgctcgactgcaccctcaccttccttggggatctgccccgcggcggtgataccctgcgctacgatatctccatcaaccactttgcccgcaatggcgataccctgctatttttcttctcctacgaatgctttgtgggcgataagctgatcctcaagatggacggcggctgcgcgggattctttaccgataaagaactggccgatggcaaaggggtgattcgcaccgaggtcgaaattaaggtgcgcgagcaagcacaaattgcactggccaatgaatatacccgaaacggcaataagccacgcttcacgccgctacttaactgcgcgcaaactgcctttagctacggccaaatccatcgtctactgagcgccgacattggtggctgtttcggcggtgaacatgcggcccatcaagcaaagtttggtctccagccttcactctgcttcgcctcggaaaaattcctgatgatcgagcaagtcagtaagctcgaagtgcatggcggcgcctggggcttaggcttgattgaaggtcacaagcaattagcccccgaccattggtatttcccctgccatttcaagggcgaccaagtgatggcaggctccctcatggccgaaggttgtggccagttactgcaattttttatgctgcatattggtatgcatgctaatacacaagcaggtggcgttactaacggccgtttccaaccccttgaaaacgcatcgcaaaaagtgcgctgccgcggtcaggtattgccacaatctggcaccctcacctatcgcatggaagtcaccgaaatcggcatgagccctcgcccctatgccaaggcgaatattgatattctgctcaatggcaaagtggtggtggatttccaaaatctcggggtgatgattaaagaagaagcggattgcacccgctattcgcaaagccattcttcacagggtaatcatacgcaagcagcaaatatcgaaagtctcgcggaacaagcgccgctaatggcgcaaatcccagatgttgcagctccggtcaataaaggcgttgtgccgcttaagcatgtgagcgcgccgattgcgccagcaggctctaagtacgccaaccgcgtgcccgacaccctgccgtttactccttatcatttatttgagtttgccaccggcgatattgaaaactgcttcggccccgattttagtatttaccgtggcttaatcccgccgcgtacgccctgtggcgatctgcaactcactacccgagtggtggctattgaaggcaaacgtggcgagctgaaaaagccatccacctgtattgccgagtatgaagtgcccagcaacgcgtggtattaccgtaaaaccagccacccgagtgtaatgccctactctgtgctgatggaaatatcattgcagccaaatggctttatctcgggttatatgggcacgaccttaggctttccagggcaggagttattcttccgcaatctcgacggcagtggcaagttactgcgcgaagtggatttacgcggtaagaccatagtcaatgattcgcgcctgctgtctaccgtgattgctggcagcaatatcattcaaaactttagctttgagctgagctgcgatggcgagcccttctaccgtggtaatgcggttttcggttactttaaggccgatgcgcttaaaaaccagttgggtatcgacaatggtaaaattacccaagcgtggcaccttgagcgcggtatcaaagccgactgccaaatcaatctgttagataaaaatggccgcagtttcgtggcgccgctgggcaagccacactaccgcctagcgggtgggcagctgaactttatcgacaaggccgaaattgtaaaaactggcggtaagaaggggctcggatacttatacgccgagcgcaccattgacccgagcgattggttcttccagttccatttccatcaggaccctgtaatgccaggctccctcggtgtcgaggcgattatcgaattactgcaaacctatgccatagaccaagacctaggcgcaggtttcaataatccgaaatttggccaaattctgtcagaaattaaatggaagtatcgcggtcaaattaatccattaaacaaacagatgtcgctggatgtgcatatcaccagcattgaagataaagacggtaaacgcatcatcaagggcgatgccaacctgagtaaggatggcctgcgcatttatgaggtgaccgatattgccatctgcatcgaagaggcatag

SEQ ID NO: 78 - protein, 1963 aa, Shewanella oneidensis MR-1
MSSQMHTHPTLQDSAAVPNDQRQTLKAMPKIAIVGLAVQYPDADTPEQFWQNLLDKKDSRSQIDAAKLNANPADYQGIQGQADRFYCDKGGYIRNFRFDPQGYQLLPATFAGLDESFLWALDCSKKALLNAGVDLTAPLLERTGIVMGTLSFPTARSNELFLPIYHQAVEKALKTKLNQPQFALAPFANASIAGSQLAANGVIAHTASKLLSDALGLGGAQLSLDAACASSVYALKLACDYLTTGKADMMLAGAVSGADPFFINMGFSIFHAYPDHGISAPFDSNSKGLFAGEGAGVLVLKRLEDAERDGDNIYAVVSGIGLSNDGKGQFVLSPNSKGQVQAFERAYAAANTHPSNIEVIECHATGTPLGDKVELTSMERFFEDKLDGTKAPLIGSAKSNLGHLLTAAGMPGIMKMIFAMRSGHLPPSINLTAPISSPKGLFSVNNLPTQRQAWPDKAGNDRRHAGVSVFGFGGCNAHLLLESYQPTAHSAEKQANKPVYQQQALTVIGMASHFGPLASINALDKALIAQTDAFIPLPPKRWKGLDKHPDILQQFGLNRAPKGAYIEQFDFDFLRFKVPPNEDDRLISQQLLLIKVADEAIRDAKLTAGSKVAVLVAMETELELHQFRGRVNLHTQLADSLKKQGVHLSNDEYLALEAIAMDSVLDAAKLNQYTSFIGNIMASRIASLWDFNGPAFTISAAEQSVARCIDVAQNLLSKEALDGVVIAAVDLSGSVEQVILKNAQVAVDLDANSANPQWKVGEGAGAIVLTNQQASNSQQAGYGQIRGQAFGTNHQLPKLLDSLITETAIANPSMPTAIHMIEQCIAPEEQLPAEHLLAQLNLLGTSCNRVANTLGHNFAAAGMASLLSALLSLKNRSANSDKNAEKQALVSTQSQGVSSLLLLSQTATQAAQLELRLAQDLTLSEQKHLIKPVTLGGRDIYQHIVDTPLPALAAIQGKMRQLQPLASQATQTKPAVGAALDITAENATPLAAESGMSSNAPLQFETTASAQDSAALLQNQQLAREAHLAFLQSREQGLKLADALLKAQLSQTTQMGAVAAHVATSANVAETKAQQAVSIPELMPNHAPNHARVPPYTPPIPAAKPCIWNYQDLVEYAEGDIAKVFGADYAIIDSYARRVRLPTSDYLLVSRVTKLNAQMNRYQPSSMTTEYDIPVDAPFLVDGQIPWAVAVESGQCDLMLISYLGIDFENKGERVYRLLDCTLTFLGDLPRGGDTLRYDISINHFARNGDTLLFFFSYECFVGDKLILKMDGGCAGFFTDKELADGKGVIRTEVEIKVREQAQIALANEYTRNGNKPRFTPLLNCAQTAFSYGQIHRLLSADIGGCFGGEHAAHQAKFGLQPSLCFASEKFLMIEQVSKLEVHGGAWGLGLIEGHKQLAPDHWYFPCHFKGDQVMAGSLMAEGCGQLLQFFMLHIGMHANTQAGGVTNGRFQPLENASQKVRCRGQVLPQSGTLTYRMEVTEIGMSPRPYAKANIDILLNGKVVVDFQNLGVMIKEEADCTRYSQSHSSQGNHTQAANIESLAEQAPLMAQIPDVAAPVNKGVVPLKHVSAPIAPAGSKYANRVPDTLPFTPYHLFEFATGDIENCFGPDFSIYRGLIPPRTPCGDLQLTTRVVAIEGKRGELKKPSTCIAEYEVPSNAWYYRKTSHPSVMPYSVLMEISLQPNGFISGYMGTTLGFPGQELFFRNLDGSGKLLREVDLRGKTIVNDSRLLSTVIAGSNIIQNFSFELSCDGEPFYRGNAVFGYFKADALKNQLGIDNGKITQAWHLERGIKADCQINLLDKNGRSFVAPLGKPHYRLAGGQLNFIDKAEIVKTGGKKGLGYLYAERTIDPSDWFFQFHFHQDPVMPGSLGVEAIIELLQTYAIDQDLGAGFNNPKFGQILSEIKWKYRGQINPLNKQMSLDVHITSIEDKDGKRIIKGDANLSKDGLRIYEVTDIAICIEEA

SEQ ID NO: 79 - DNA, 1644 bp, Shewanella oneidensis MR-1
  CDS (1)..(1644)
atgacgaataccacactcgataataacgctctcgataataacaagctcagtccttggccgtggcaggttgatgaagccgccatcagtttcgatatcgaatcccttggcaaaaaactcaaagatctcaatcaagcctgttacttaatcaaccatgctgagaaaggcttaggcatagcccaaagcgccgaagtggtcggtcttgcagaacccaataatggtttgcatcctgtaagcgccttcgcccccgcccttggcacccagagcttgggtgacagtaattttcgccgcgtgcatggggtgaaatacgcttactacgcgggcgccatggccaacggtatcgcctcggaagagttagttatcgccttaggtcaggcgggcattttgtgctcctttggcgcggcagggttaattccgtcgcgcgtggaagccgcgattaaacgcattcaagcggcattgcccaatggtccctacgcctttaacttgatccatagcccgagcgagcaagcgctggagcgtggcagtgtcgaactcttccttaaacatcaagtgcgtacggttgaggcctcggctttcttgggcttaacgccgcaaatcgtctattaccgcgccgcaggcctgagtcgcgacgccagcggcgagattgtgattggcaataaagtgattgctaaaatcagccgtactgaggtggctaccaagtttatggagcccgcccccgttaagatactgcaacaattagtgaacgaagggcttatcagcgaagatcaaatgctgatggcgcaatctgtgcccatggccgatgacattaccgccgaagcagactcaggcggccacaccgacaatcgccctctggtcacgctattgccaaccattttggcgctcaaagataccattcaagccaagtaccagtataaaacgccgatccgagtgggcgcaggtggggggatcggcacccccgatgcggcgctggcgaccttcaatatgggcgcggcctatattgtcaccggctcaatcaaccaagcctgcgtggaagcgggtgccagcgaacatacccgtaagttactcgccaccactgaaatggccgatgtgactatggcgcccgccgccgatatgtttgaaatgggcgttaagttacaagtggttaagcgcggcaccctattcccgatgcgcgccaataagctctacgagatttacacccgctacgactcgatagaggcgattccagcagaggaaaggcaaaagctggaagagcaagtatttcgcgcctcattagatgagatttgggcaggtactgtggcgcactttaatgagcgcgatcctaagcaaattgagcgcgcgctggataaccctaaacgcaaaatggcactgattttccgctggtatttaggtttatcgagccgctggtcaaacactggtgaagtcggccgcgaaatggattaccagatttgggcaggccccgccctcggcgcctttaatgcttgggctaaaggcagttatttagatgattaccgcgagcgcaatgcggtcgacttggcgaaacatttaatgcaaggcgccgcctaccaagcacggattaacctgttgttatcccaaggggtaagtattccagtcagcctgcaacgttggaaacctctgcaacgctgctaa

SEQ ID NO: 80 - protein, 547 aa, Shewanella oneidensis MR-1
MTNTTLDNNALDNNKLSPWPWQVDEAAISFDIESLGKKLKDLNQACYLINHAEKGLGIAQSAEVVGLAEPNNGLHPVSAFAPALGTQSLGDSNFRRVHGVKYAYYAGAMANGIASEELVIALGQAGILCSFGAAGLIPSRVEAAIKRIQAALPNGPYAFNLIHSPSEQALERGSVELFLKHQVRTVEASAFLGLTPQIVYYRAAGLSRDASGEIVIGNKVIAKISRTEVATKFMEPAPVKILQQLVNEGLISEDQMLMAQSVPMADDITAEADSGGHTDNRPLVTLLPTILALKDTIQAKYQYKTPIRVGAGGGIGTPDAALATFNMGAAYIVTGSINQACVEAGASEHTRKLLATTEMADVTMAPAADMFEMGVKLQVVKRGTLFPMRANKLYEIYTRYDSIEAIPAEERQKLEEQVFRASLDEIWAGTVAHFNERDPKQIERALDNPKRKMALIFRWYLGLSSRWSNTGEVGREMDYQIWAGPALGAFNAWAKGSYLDDYRERNAVDLAKHLMQGAAYQARINLLLSQGVSIPVSLQRWKPLQRC

SEQ ID NO: 81 - DNA, 957 bp, Shewanella oneidensis MR-1
  CDS (1)..(957)
atgaagattgagcttttttttataccattagccgagatggatgctgaaatggtgagccgttgtatggcgctgttgagtgaggacgagcgtgcaaaagtggcgcgttaccttgcgcccaaggcgcaaatgaatggcttattggtgcgagcggcgctgcgctgtgtcttatctcaagggctgcaatctccaaatgaatcttcacttaacgcattttcatctaacacaggctcactacccattgctccccaagattggtgttttgagtatggggcaaagggcaaacccagtctctgccatgagcagtttctgaagacgggtattgagtttaacttaagccacagtggcgactggttattgatagccttggcgcaagggcgggctcatacaaaattcatcgatcaaagtgcaaaaactcgcttaggtttaggtgtcgatattgagcgggcccgggcaagcacaaatatttaccccattctgaatcattatttttctgcgcgagaaaccgaggcgctactggcattgccgggcgaaaccgcccaccgccaacgattttttgacctgtgggcgcttaaagagtcctacatcaaggcaacaggtttaggcttagcgcagtcgttaaaatcctttgcctttgagttgatgcctgatgcacttgtcgaggtccatcccaatcaagtagcgcttcgccatgaatgggttgaacttaaaaggcgagaaccctttgcgttaccaagccagcttaaattgtattgcgagattaagcctacggcggcgtttctgcccgattctgcgcatccgccgccagaaaacttgcacgtgcaaagctactttggtcggcttgatgaggaatatcgctttggcttgagtctcattcatcctaacgcgctatcgaatgtgcagatttcgatgacgcttgccagcatcaaatcgttgttagcggctagtttggctgactaa

SEQ ID NO: 82 - protein, 318 aa, Shewanella oneidensis MR-1
MKIELFFIPLAEMDAEMVSRCMALLSEDERAKVARYLAPKAQMNGLLVRAALRCVLSQGLQSPNESSLNAFSSNTGSLPIAPQDWCFEYGAKGKPSLCHEQFLKTGIEFNLSHSGDWLLIALAQGRAHTKFIDQSAKTRLGLGVDIERARASTNIYPILNHYFSARETEALLALPGETAHRQRFFDLWALKESYIKATGLGLAQSLKSFAFELMPDALVEVHPNQVALRHEWVELKRREPFALPSQLKLYCEIKPTAAFLPDSAHPPPENLHVQSYFGRLDEEYRFGLSLIHPNALSNVQISMTLASIKSLLAASLAD

SEQ ID NO: 83 - DNA, 8733 bp, Schizochytorium sp.
  CDS (1)..(8733)
atggcggcccgtctgcaggagcaaaagggaggcgagatggatacccgcattgccatcatcggcatgtcggccatcctcccctgcggcacgaccgtgcgcgagtcgtgggagaccatccgcgccggcatcgactgcctgtcggatctccccgaggaccgcgtcgacgtgacggcgtactttgaccccgtcaagaccaccaaggacaagatctactgcaagcgcggtggcttcattcccgagtacgactttgacgcccgcgagttcggactcaacatgttccagatggaggactcggacgcaaaccagaccatctcgcttctcaaggtcaaggaggccctccaggacgccggcatcgacgccctcggcaaggaaaagaagaacatcggctgcgtgctcggcattggcggcggccaaaagtccagccacgagttctactcgcgccttaattatgttgtcgtggagaaggtcctccgcaagatgggcatgcccgaggaggacgtcaaggtcgccgtcgaaaagtacaaggccaacttccccgagtggcgcctcgactccttccctggcttcctcggcaacgtcaccgccggtcgctgcaccaacaccttcaacctcgacggcatgaactgcgttgtcgacgccgcatgcgcctcgtccctcatcgccgtcaaggtcgccatcgacgagctgctctacggtgactgcgacatgatggtcaccggtgccacctgcacggataactccatcggcatgtacatggccttctccaagacccccgtgttctccacggaccccagcgtgcgcgcctacgacgaaaagacaaagggcatgctcatcggcgagggctccgccatgctcgtcctcaagcgctacgccgacgccgtccgcgacggcgatgagatccacgctgttattcgcggctgcgcctcctccagtgatggcaaggccgccggcatctacacgcccaccatttcgggccaggaggaggccctccgccgcgcctacaaccgcgcctgtgtcgacccggccaccgtcactctcgtcgagggtcacggcaccggtactcccgttggcgaccgcatcgagctcaccgccttgcgcaacctctttgacaaggcctacggcgagggcaacaccgaaaaggtcgctgtgggcagcatcaagtccagcatcggccatctcaaggccgtcgccggtctcgccggtatgatcaaggtcatcatggcgctcaagcacaagactctcccgggcaccatcaacgtcgacaacccacccaacctctacgacaacacgcccatcaacgagtcctcgctctacattaacaccatgaaccgcccctggttcccgccccctggtgtgccccgccgcgccggcatttcgagctttggctttggtggcgccaactaccacgccgtcctcgaggaggccgagcccgagcacacgaccgcgtaccgcctcaacaagcgcccgcagcccgtgctcatgatggccgccacgcccgcggccctccagtcgctctgcgaggcccagctcaaggagttcgaggccgccatcaaggagaacgagaccgtcaagaacaccgcctacatcaagtgcgtcaagttcggcgagcagttcaaattccctggctccatcccggccacaaacgcgcgcctcggcttcctcgtcaaggatgctgaggatgcctgctccaccctccgtgccatctgcgcccaattcgccaaggatgtcaccaaggaggcctggcgcctcccccgcgagggcgtcagcttccgcgccaagggcatcgccaccaacggcgctgtcgccgcgctcttctccggccagggcgcgcagtacacgcacatgtttagcgaggtggccatgaactggccccagttccgccagagcattgccgccatggacgccgcccagtccaaggtcgctggaagcgacaaggactttgagcgcgtctcccaggtcctctacccgcgcaagccgtacgagcgtgagcccgagcaggaccacaagaagatctccctcaccgcctactcgcagccctcgaccctggcctgcgctctcggtgcctttgagatcttcaaggaggccggcttcaccccggactttgccgccggccattcgctcggtgagttcgccgccctctacgccgcgggctgcgtcgaccgcgacgagctctttgagcttgtctgccgccgcgcccgcatcatgggcggcaaggacgcaccggccacccccaagggctgcatggccgccgtcattggccccaacgccgagaacatcaaggtccaggccgccaacgtctggctcggcaactccaactcgccttcgcagaccgtcatcaccggctccgtcgaaggtatccaggccgagagcgcccgcctccagaaggagggcttccgcgtcgtgcctcttgcctgcgagagcgccttccactcgccccagatggagaacgcctcgtcggccttcaaggacgtcatctccaaggtctccttccgcacccccaaggccgagaccaagctcttcagcaacgtctctggcgagacctaccccacggacgcccgcgagatgcttacgcagcacatgaccagcagcgtcaagttcctcacccaggtccgcaacatgcaccaggccggtgcgcgcatctttgtcgagttcggacccaagcaggtgctctccaagcttgtctccgagaccctcaaggatgacccctcggttgtcaccgtctctgtcaacccggcctcgggcacggattcggacatccagctccgcgacgcggccgtccagctcgttgtcgctggcgtcaaccttcagggctttgacaagtgggacgcccccgatgccacccgcatgcaggccatcaagaagaagcgcactaccctccgcctttcggccgccacctacgtctcggacaagaccaagaaggtccgcgacgccgccatgaacgatggccgctgcgtcacctacctcaagggcgccgcaccgctcatcaaggccccggagcccgttgtcgacgaggccgccaagcgcgaggccgagcgtctccagaaggagcttcaggatgcccagcgccagctcgacgacgccaagcgcgccgccgccgaggccaactccaagctcgccgctgccaaggaggaggccaagaccgccgctgcttcggccaagcccgcagttgacactgctgttgtcgaaaagcatcgtgccatcctcaagtccatgctcgcggagctcgatggctacggatcggtcgacgcttcttccctccagcagcagcagcagcagcagacggcccccgccccggtcaaggctgctgcgcctgccgcccccgttgcctcggcccctgccccggctgtctcgaacgagcttcttgagaaggccgagactgtcgtcatggaggtcctcgccgccaagaccggctacgagaccgacatgatcgaggctgacatggagctcgagaccgagctcggcattgactccatcaagcgtgtcgagatcctctccgaggtccaggccatgctcaatgtcgaggccaaggatgtcgatgccctcagccgcactcgcactgttggtgaggttgtcaacgccatgaaggccgagatcgctggcagctctgccccggcgcctgctgccgctgctccggctccggccaaggctgcccctgccgccgctgcgcctgctgtctcgaacgagcttctcgagaaggccgagaccgtcgtcatggaggtcctcgccgccaagactggctacgagactgacatgatcgagtccgacatggagctcgagactgagctcggcattgactccatcaagcgtgtcgagatcctctccgaggttcaggccatgctcaacgtcgaggccaaggacgtcgacgctctcagccgcactcgcactgtgggtgaggtcgtcaacgccatgaaggctgagatcgctggtggctctgccccggcgcctgccgccgctgccccaggtccggctgctgccgcccctgcgcctgccgccgccgcccctgctgtctcgaacgagcttcttgagaaggccgagaccgtcgtcatggaggtcctcgccgccaagactggctacgagactgacatgatcgagtccgacatggagctcgagaccgagctcggcattgactccatcaagcgtgtcgagattctctccgaggtccaggccatgctcaacgtcgaggccaaggacgtcgacgctctcagccgcacccgcactgttggcgaggtcgtcgatgccatgaaggccgagatcgctggtggctctgccccggcgcctgccgccgctgctcctgctccggctgctgccgcccctgcgcctgccgcccctgcgcctgctgtctcgagcgagcttctcgagaaggccgagactgtcgtcatggaggtcctcgccgccaagactggctacgagactgacatgatcgagtccgacatggagctcgagaccgagctcggcattgactccatcaagcgtgtcgagattctctccgaggtccaggccatgctcaacgtcgaggccaaggacgtcgacgctctcagccgcacccgcactgttggcgaggtcgtcgatgccatgaaggccgagatcgctggtggctctgccccggcgcctgccgccgctgctcctgctccggctgctgccgcccctgcgcctgccgcccctgcgcctgccgcccctgcgcctgctgtctcgagcgagcttctcgagaaggccgagactgtcgtcatggaggtcctcgccgccaagactggctacgagactgacatgattgagtccgacatggagctcgagaccgagctcggcattgactccatcaagcgtgtcgagattctctccgaggttcaggccatgctcaacgtcgaggccaaggacgtcgacgctctcagccgcactcgcactgttggtgaggtcgtcgatgccatgaaggctgagatcgctggcagctccgcctcggcgcctgccgccgctgctcctgctccggctgctgccgctcctgcgcccgctgccgccgcccctgctgtctcgaacgagcttctcgagaaagccgagactgtcgtcatggaggtcctcgccgccaagactggctacgagactgacatgatcgagtccgacatggagctcgagactgagctcggcattgactccatcaagcgtgtcgagatcctctccgaggttcaggccatgctcaacgtcgaggccaaggacgtcgatgccctcagccgcacccgcactgttggcgaggttgtcgatgccatgaaggccgagatcgctggtggctctgccccggcgcctgccgccgctgcccctgctccggctgccgccgcccctgctgtctcgaacgagcttctcgagaaggccgagactgtcgtcatggaggtcctcgccgccaagactggctacgagaccgacatgatcgagtccgacatggagctcgagaccgagctcggcattgactccatcaagcgtgtcgagattctctccgaggttcaggccatgctcaacgtcgaggccaaggacgtcgatgctctcagccgcactcgcactgttggcgaggtcgtcgatgccatgaaggctgagatcgccggcagctccgccccggcgcctgccgccgctgctcctgctccggctgctgccgctcctgcgcccgctgccgctgcccctgctgtctcgagcgagcttctcgagaaggccgagaccgtcgtcatggaggtcctcgccgccaagactggctacgagactgacatgattgagtccgacatggagctcgagactgagctcggcattgactccatcaagcgtgtcgagatcctctccgaggttcaggccatgctcaacgtcgaggccaaggacgtcgatgccctcagccgcacccgcactgttggcgaggttgtcgatgccatgaaggccgagatcgctggtggctctgccccggcgcctgccgccgctgcccctgctccggctgccgccgcccctgctgtctcgaacgagcttcttgagaaggccgagaccgtcgtcatggaggtcctcgccgccaagactggctacgagaccgacatgatcgagtccgacatggagctcgagaccgagctcggcattgactccatcaagcgtgtcgagattctctccgaggttcaggccatgctcaacgtcgaggccaaggacgtcgacgctctcagccgcactcgcactgttggcgaggtcgtcgatgccatgaaggctgagatcgctggtggctctgccccggcgcctgccgccgctgctcctgcctcggctggcgccgcgcctgcggtcaagattgactcggtccacggcgctgactgtgatgatctttccctgatgcacgccaaggtggttgacatccgccgcccggacgagctcatcctggagcgccccgagaaccgccccgttctcgttgtcgatgacggcagcgagctcaccctcgccctggtccgcgtcctcggcgcctgcgccgttgtcctgacctttgagggtctccagctcgctcagcgcgctggtgccgctgccatccgccacgtgctcgccaaggatctttccgcggagagcgccgagaaggccatcaaggaggccgagcagcgctttggcgctctcggcggcttcatctcgcagcaggcggagcgcttcgagcccgccgaaatcctcggcttcacgctcatgtgcgccaagttcgccaaggcttccctctgcacggctgtggctggcggccgcccggcctttatcggtgtggcgcgccttgacggccgcctcggattcacttcgcagggcacttctgacgcgctcaagcgtgcccagcgtggtgccatctttggcctctgcaagaccatcggcctcgagtggtccgagtctgacgtcttttcccgcggcgtggacattgctcagggcatgcaccccgaggatgccgccgtggcgattgtgcgcgagatggcgtgcgctgacattcgcattcgcgaggtcggcattggcgcaaaccagcagcgctgcacgatccgtgccgccaagctcgagaccggcaacccgcagcgccagatcgccaaggacgacgtgctgctcgtttctggcggcgctcgcggcatcacgcctctttgcatccgggagatcacgcgccagatcgcgggcggcaagtacattctgcttggccgcagcaaggtctctgcgagcgaaccggcatggtgcgctggcatcactgacgagaaggctgtgcaaaaggctgctacccaggagctcaagcgcgcctttagcgctggcgagggccccaagcccacgccccgcgctgtcactaagcttgtgggctctgttcttggcgctcgcgaggtgcgcagctctattgctgcgattgaagcgctcggcggcaaggccatctactcgtcgtgcgacgtgaactctgccgccgacgtggccaaggccgtgcgcgatgccgagtcccagctcggtgcccgcgtctcgggcatcgttcatgcctcgggcgtgctccgcgaccgtctcatcgagaagaagctccccgacgagttcgacgccgtctttggcaccaaggtcaccggtctcgagaacctcctcgccgccgtcgaccgcgccaacctcaagcacatggtcctcttcagctcgctcgccggcttccacggcaacgtcggccagtctgactacgccatggccaacgaggcccttaacaagatgggcctcgagctcgccaaggacgtctcggtcaagtcgatctgcttcggtccctgggacggtggcatggtgacgccgcagctcaagaagcagttccaggagatgggcgtgcagatcatcccccgcgagggcggcgctgataccgtggcgcgcatcgtgctcggctcctcgccggctgagatccttgtcggcaactggcgcaccccgtccaagaaggtcggctcggacaccatcaccctgcaccgcaagatttccgccaagtccaaccccttcctcgaggaccacgtcatccagggccgccgcgtgctgcccatgacgctggccattggctcgctcgcggagacctgcctcggcctcttccccggctactcgctctgggccattgacgacgcccagctcttcaagggtgtcactgtcgacggcgacgtcaactgcgaggtgaccctcaccccgtcgacggcgccctcgggccgcgtcaacgtccaggccacgctcaagaccttttccagcggcaagctggtcccggcctaccgcgccgtcatcgtgctctccaaccagggcgcgcccccggccaacgccaccatgcagccgccctcgctcgatgccgatccggcgctccagggctccgtctacgacggcaagaccctcttccacggcccggccttccgcggcatcgatgacgtgctctcgtgcaccaagagccagcttgtggccaagtgcagcgctgtccccggctccgacgccgctcgcggcgagtttgccacggacactgacgcccatgaccccttcgtgaacgacctggcctttcaggccatgctcgtctgggtgcgccgcacgctcggccaggctgcgctccccaactcgatccagcgcatcgtccagcaccgcccggtcccgcaggacaagcccttctacattaccctccgctccaaccagtcgggcggtcactcccagcacaagcacgcccttcagttccacaacgagcagggcgatctcttcattgatgtccaggcttcggtcatcgccacggacagccttgccttctaa

SEQ ID NO: 84 - protein, 2910 aa, Schizochytorium sp.
MAARLQEQKGGEMDTRIAIIGMSAILPCGTTVRESWETIRAGIDCLSDLPEDRVDVTAYFDPVKTTKDKIYCKRGGFIPEYDFDAREFGLNMFQMEDSDANQTISLLKVKEALQDAGIDALGKEKKNIGCVLGIGGGQKSSHEFYSRLNYVVVEKVLRKMGMPEEDVKVAVEKYKANFPEWRLDSFPGFLGNVTAGRCTNTFNLDGMNCVVDAACASSLIAVKVAIDELLYGDCDMMVTGATCTDNSIGMYMAFSKTPVFSTDPSVRAYDEKTKGMLIGEGSAMLVLKRYADAVRDGDEIHAVIRGCASSSDGKAAGIYTPTISGQEEALRRAYNRACVDPATVTLVEGHGTGTPVGDRIELTALRNLFDKAYGEGNTEKVAVGSIKSSIGHLKAVAGLAGMIKVIMALKHKTLPGTINVDNPPNLYDNTPINESSLYINTMNRPWFPPPGVPRRAGISSFGFGGANYHAVLEEAEPEHTTAYRLNKRPQPVLMMAATPAALQSLCEAQLKEFEAAIKENETVKNTAYIKCVKFGEQFKFPGSIPATNARLGFLVKDAEDACSTLRAICAQFAKDVTKEAWRLPREGVSFRAKGIATNGAVAALFSGQGAQYTHMFSEVAMNWPQFRQSIAAMDAAQSKVAGSDKDFERVSQVLYPRKPYEREPEQDHKKISLTAYSQPSTLACALGAFEIFKEAGFTPDFAAGHSLGEFAALYAAGCVDRDELFELVCRRARIMGGKDAPATPKGCMAAVIGPNAENIKVQAANVWLGNSNSPSQTVITGSVEGIQAESARLQKEGFRVVPLACESAFHSPQMENASSAFKDVISKVSFRTPKAETKLFSNVSGETYPTDAREMLTQHMTSSVKFLTQVRNMHQAGARIFVEFGPKQVLSKLVSETLKDDPSVVTVSVNPASGTDSDIQLRDAAVQLVVAGVNLQGFDKWDAPDATRMQAIKKKRTTLRLSAATYVSDKTKKVRDAAMNDGRCVTYLKGAAPLIKAPEPVVDEAAKREAERLQKELQDAQRQLDDAKRAAAEANSKLAAAKEEAKTAAASAKPAVDTAVVEKHRAILKSMLAELDGYGSVDASSLQQQQQQQTAPAPVKAAAPAAPVASAPAPAVSNELLEKAETVVMEVLAAKTGYETDMIEADMELETELGIDSIKRVEILSEVQAMLNVEAKDVDALSRTRTVGEVVNAMKAEIAGSSAPAPAAAAPAPAKAAPAAAAPAVSNELLEKAETVVMEVLAAKTGYETDMIESDMELETELGIDSIKRVEILSEVQAMLNVEAKDVDALSRTRTVGEVVNAMKAEIAGGSAPAPAAAAPGPAAAAPAPAAAAPAVSNELLEKAETVVMEVLAAKTGYETDMIESDMELETELGIDSIKRVEILSEVQAMLNVEAKDVDALSRTRTVGEVVDAMKAEIAGGSAPAPAAAAPAPAAAAPAPAAPAPAVSSELLEKAETVVMEVLAAKTGYETDMIESDMELETELGIDSIKRVEILSEVQAMLNVEAKDVDALSRTRTVGEVVDAMKAEIAGGSAPAPAAAAPAPAAAAPAPAAPAPAAPAPAVSSELLEKAETVVMEVLAAKTGYETDMIESDMELETELGIDSIKRVEILSEVQAMLNVEAKDVDALSRTRTVGEVVDAMKAEIAGSSASAPAAAAPAPAAAAPAPAAAAPAVSNELLEKAETVVMEVLAAKTGYETDMIESDMELETELGIDSIKRVEILSEVQAMLNVEAKDVDALSRTRTVGEVVDAMKAEIAGGSAPAPAAAAPAPAAAAPAVSNELLEKAETVVMEVLAAKTGYETDMIESDMELETELGIDSIKRVEILSEVQAMLNVEAKDVDALSRTRTVGEVVDAMKAEIAGSSAPAPAAAAPAPAAAAPAPAAAAPAVSSELLEKAETVVMEVLAAKTGYETDMIESDMELETELGIDSIKRVEILSEVQAMLNVEAKDVDALSRTRTVGEVVDAMKAEIAGGSAPAPAAAAPAPAAAAPAVSNELLEKAETVVMEVLAAKTGYETDMIESDMELETELGIDSIKRVEILSEVQAMLNVEAKDVDALSRTRTVGEVVDAMKAEIAGGSAPAPAAAAPASAGAAPAVKIDSVHGADCDDLSLMHAKVVDIRRPDELILERPENRPVLVVDDGSELTLALVRVLGACAVVLTFEGLQLAQRAGAAAIRHVLAKDLSAESAEKAIKEAEQRFGALGGFISQQAERFEPAEILGFTLMCAKFAKASLCTAVAGGRPAFIGVARLDGRLGFTSQGTSDALKRAQRGAIFGLCKTIGLEWSESDVFSRGVDIAQGMHPEDAAVAIVREMACADIRIREVGIGANQQRCTIRAAKLETGNPQRQIAKDDVLLVSGGARGITPLCIREITRQIAGGKYILLGRSKVSASEPAWCAGITDEKAVQKAATQELKRAFSAGEGPKPTPRAVTKLVGSVLGAREVRSSIAAIEALGGKAIYSSCDVNSAADVAKAVRDAESQLGARVSGIVHASGVLRDRLIEKKLPDEFDAVFGTKVTGLENLLAAVDRANLKHMVLFSSLAGFHGNVGQSDYAMANEALNKMGLELAKDVSVKSICFGPWDGGMVTPQLKKQFQEMGVQIIPREGGADTVARIVLGSSPAEILVGNWRTPSKKVGSDTITLHRKISAKSNPFLEDHVIQGRRVLPMTLAIGSLAETCLGLFPGYSLWAIDDAQLFKGVTVDGDVNCEVTLTPSTAPSGRVNVQATLKTFSSGKLVPAYRAVIVLSNQGAPPANATMQPPSLDADPALQGSVYDGKTLFHGPAFRGIDDVLSCTKSQLVAKCSAVPGSDAARGEFATDTDAHDPFVNDLAFQAMLVWVRRTLGQAALPNSIQRIVQHRPVPQDKPFYITLRSNQSGGHSQHKHALQFHNEQGDLFIDVQASVIATDSLAF

SEQ ID NO: 85 - DNA, 6180 bp, Schizochytorium sp.
  CDS (1)..(6180)
atggccgctcggaatgtgagcgccgcgcatgagatgcacgatgaaaagcgcatcgccgtcgtcggcatggccgtccagtacgccggatgcaaaaccaaggacgagttctgggaggtgctcatgaacggcaaggtcgagtccaaggtgatcagcgacaaacgactcggctccaactaccgcgccgagcactacaaagcagagcgcagcaagtatgccgacaccttttgcaacgaaacgtacggcacccttgacgagaacgagatcgacaacgagcacgaactcctcctcaacctcgccaagcaggcactcgcagagacatccgtcaaagactcgacacgctgcggcatcgtcagcggctgcctctcgttccccatggacaacctccagggtgaactcctcaacgtgtaccaaaaccatgtcgagaaaaagctcggggcccgcgtcttcaaggacgcctcccattggtccgaacgcgagcagtccaacaaacccgaggccggtgaccgccgcatcttcatggacccggcctccttcgtcgccgaagaactcaacctcggcgcccttcactactccgtcgacgcagcatgcgccacggcgctctacgtgctccgcctcgcgcaggatcatctcgtctccggcgccgccgacgtcatgctctgcggtgccacctgcctgccggagccctttttcatcctttcgggcttttccaccttccaggccatgcccgtcggcacgggccagaacgtgtccatgccgctgcacaaggacagccagggcctcaccccgggtgagggcggctccatcatggtcctcaagcgtctcgatgatgccatccgcgacggcgaccacatctacggcacccttctcggcgccaatgtcagcaactccggcacaggtctgcccctcaagccccttctccccagcgagaaaaagtgcctcatggacacctacacgcgcattaacgtgcacccgcacaagattcagtacgtcgagtgccacgccaccggcacgccccagggtgatcgtgtggaaatcgacgccgtcaaggcctgctttgaaggcaaggtcccccgtttcggtaccacaaagggcaactttggacacaccctcgtcgcagccggctttgccggtatgtgcaaggtcctcctctccatgaagcatggcatcatcccgcccaccccgggtatcgatgacgagaccaagatggaccctctcgtcgtctccggtgaggccatcccatggccagagaccaacggcgagcccaagcgcgccggtctctcggcctttggctttggtggcaccaacgcccatgccgtctttgaggagcatgacccctccaacgccgcctgcacgggccacgactccatttctgcgctctcggcccgctgcggcggtgaaagcaacatgcgcatcgccatcactggtatggacgccacctttggcgctctcaagggactcgacgccttcgagcgcgccatttacaccggcgctcacggtgccatcccactcccagaaaagcgctggcgctttctcggcaaggacaaggactttcttgacctctgcggcgtcaaggccaccccgcacggctgctacattgaagatgttgaggtcgacttccagcgcctccgcacgcccatgacccctgaagacatgctcctccctcagcagcttctggccgtcaccaccattgaccgcgccatcctcgactcgggaatgaaaaagggtggcaatgtcgccgtctttgtcggcctcggcaccgacctcgagctctaccgtcaccgtgctcgcgtcgctctcaaggagcgcgtccgccctgaagcctccaagaagctcaatgacatgatgcagtacattaacgactgcggcacatccacatcgtacacctcgtacattggcaacctcgtcgccacgcgcgtctcgtcgcagtggggcttcacgggcccctcctttacgatcaccgagggcaacaactccgtctaccgctgcgccgagctcggcaagtacctcctcgagaccggcgaggtcgatggcgtcgtcgttgcgggtgtcgatctctgcggcagtgccgaaaacctttacgtcaagtctcgccgcttcaaggtgtccacctccgataccccgcgcgccagctttgacgccgccgccgatggctactttgtcggcgagggctgcggtgcctttgtgctcaagcgtgagactagctgcaccaaggacgaccgtatctacgcttgcatggatgccatcgtccctggcaacgtccctagcgcctgcttgcgcgaggccctcgaccaggcgcgcgtcaagccgggcgatatcgagatgctcgagctcagcgccgactccgcccgccacctcaaggacccgtccgtcctgcccaaggagctcactgccgaggaggaaatcggcggccttcagacgatccttcgtgacgatgacaagctcccgcgcaacgtcgcaacgggcagtgtcaaggccaccgtcggtgacaccggttatgcctctggtgctgccagcctcatcaaggctgcgctttgcatctacaaccgctacctgcccagcaacggcgacgactgggatgaacccgcccctgaggcgccctgggacagcaccctctttgcgtgccagacctcgcgcgcttggctcaagaaccctggcgagcgtcgctatgcggccgtctcgggcgtctccgagacgcgctcgtgctattccgtgctcctctccgaagccgagggccactacgagcgcgagaaccgcatctcgctcgacgaggaggcgcccaagctcattgtgcttcgcgccgactcccacgaggagatccttggtcgcctcgacaagatccgcgagcgcttcttgcagcccacgggcgccgccccgcgcgagtccgagctcaaggcgcaggcccgccgcatcttcctcgagctcctcggcgagacccttgcccaggatgccgcttcttcaggctcgcaaaagcccctcgctctcagcctcgtctccacgccctccaagctccagcgcgaggtcgagctcgcggccaagggtatcccgcgctgcctcaagatgcgccgcgattggagctcccctgctggcagccgctacgcgcctgagccgctcgccagcgaccgcgtcgccttcatgtacggcgaaggtcgcagcccttactacggcatcacccaagacattcaccgcatttggcccgaactccacgaggtcatcaacgaaaagacgaaccgtctctgggccgaaggcgaccgctgggtcatgccgcgcgccagcttcaagtcggagctcgagagccagcagcaagagtttgatcgcaacatgattgaaatgttccgtcttggaatcctcacctcaattgccttcaccaatctggcgcgcgacgttctcaacatcacgcccaaggccgcctttggcctcagtcttggcgagatttccatgatttttgccttttccaagaagaacggtctcatctccgaccagctcaccaaggatcttcgcgagtccgacgtgtggaacaaggctctggccgttgaatttaatgcgctgcgcgaggcctggggcattccacagagtgtccccaaggacgagttctggcaaggctacattgtgcgcggcaccaagcaggatatcgaggcggccatcgccccggacagcaagtacgtgcgcctcaccatcatcaatgatgccaacaccgccctcattagcggcaagcccgacgcctgcaaggctgcgatcgcgcgtctcggtggcaacattcctgcgcttcccgtgacccagggcatgtgcggccactgccccgaggtgggaccttataccaaggatatcgccaagatccatgccaaccttgagttccccgttgtcgacggccttgacctctggaccacaatcaaccagaagcgcctcgtgccacgcgccacgggcgccaaggacgaatgggccccttcttcctttggcgagtacgccggccagctctacgagaagcaggctaacttcccccaaatcgtcgagaccatttacaagcaaaactacgacgtctttgtcgaggttgggcccaacaaccaccgtagcaccgcagtgcgcaccacgcttggtccccagcgcaaccaccttgctggcgccatcgacaagcagaacgaggatgcttggacgaccatcgtcaagcttgtggcttcgctcaaggcccaccttgttcctggcgtcacgatctcgccgctgtaccactccaagcttgtggcggaggctgaggcttgctacgctgcgctctgcaagggtgaaaagcccaagaagaacaagtttgtgcgcaagattcagctcaacggtcgcttcaacagcaaggcggaccccatctcctcggccgatcttgccagctttccgcctgcggaccctgccattgaagccgccatctcgagccgcatcatgaagcctgtcgctcccaagttctacgcgcgtctcaacattgacgagcaggacgagacccgagatccgatcctcaacaaggacaacgcgccgtcttcttcttcttcttcttcttcttcttcttcttcttcttcttctccgtcgcctgctccttcggcccccgtgcaaaagaaggctgctcccgccgcggagaccaaggctgttgcttcggctgacgcacttcgcagtgccctgctcgatctcgacagtatgcttgcgctgagctctgccagtgcctccggcaaccttgttgagactgcgcctagcgacgcctcggtcattgtgccgccctgcaacattgcggatctcggcagccgcgccttcatgaaaacgtacggtgtttcggcgcctctgtacacgggcgccatggccaagggcattgcctctgcggacctcgtcattgccgccggccgccagggcatccttgcgtcctttggcgccggcggacttcccatgcaggttgtgcgtgagtccatcgaaaagattcaggccgccctgcccaatggcccgtacgctgtcaaccttatccattctccctttgacagcaacctcgaaaagggcaatgtcgatctcttcctcgagaagggtgtcacctttgtcgaggcctcggcctttatgacgctcaccccgcaggtcgtgcggtaccgcgcggctggcctcacgcgcaacgccgacggctcggtcaacatccgcaaccgtatcattggcaaggtctcgcgcaccgagctcgccgagatgttcatgcgtcctgcgcccgagcaccttcttcagaagctcattgcttccggcgagatcaaccaggagcaggccgagctcgcccgccgtgttcccgtcgctgacgacatcgcggtcgaagctgactcgggtggccacaccgacaaccgccccatccacgtcattctgcccctcatcatcaaccttcgcgaccgccttcaccgcgagtgcggctacccggccaaccttcgcgtccgtgtgggcgccggcggtggcattgggtgcccccaggcggcgctggccaccttcaacatgggtgcctcctttattgtcaccggcaccgtgaaccaggtcgccaagcagtcgggcacgtgcgacaatgtgcgcaagcagctcgcgaaggccacttactcggacgtatgcatggccccggctgccgacatgttcgaggaaggcgtcaagcttcaggtcctcaagaagggaaccatgtttccctcgcgcgccaacaagctctacgagctcttttgcaagtacgactcgttcgagtccatgccccccgcagagcttgcgcgcgtcgagaagcgcatcttcagccgcgcgctcgaagaggtctgggacgagaccaaaaacttttacattaaccgtcttcacaacccggagaagatccagcgcgccgagcgcgaccccaagctcaagatgtcgctgtgctttcgctggtacctgagcctggcgagccgctgggccaacactggagcttccgatcgcgtcatggactaccaggtctggtgcggtcctgccattggttccttcaacgatttcatcaagggaacttaccttgatccggccgtcgcaaacgagtacccgtgcgtcgttcagattaacaagcagatccttcgtggagcgtgcttcttgcgccgtctcgaaattctgcgcaacgcacgcctttccgatggcgctgccgctcttgtggccagcatcgatgacacatacgtcccggccgagaagctgtaa

SEQ ID NO: 86 - protein, 2059 aa, Schizochytorium sp.
MAARNVSAAHEMHDEKRIAVVGMAVQYAGCKTKDEFWEVLMNGKVESKVISDKRLGSNYRAEHYKAERSKYADTFCNETYGTLDENEIDNEHELLLNLAKQALAETSVKDSTRCGIVSGCLSFPMDNLQGELLNVYQNHVEKKLGARVFKDASHWSEREQSNKPEAGDRRIFMDPASFVAEELNLGALHYSVDAACATALYVLRLAQDHLVSGAADVMLCGATCLPEPFFILSGFSTFQAMPVGTGQNVSMPLHKDSQGLTPGEGGSIMVLKRLDDAIRDGDHIYGTLLGANVSNSGTGLPLKPLLPSEKKCLMDTYTRINVHPHKIQYVECHATGTPQGDRVEIDAVKACFEGKVPRFGTTKGNFGHTLVAAGFAGMCKVLLSMKHGIIPPTPGIDDETKMDPLVVSGEAIPWPETNGEPKRAGLSAFGFGGTNAHAVFEEHDPSNAACTGHDSISALSARCGGESNMRIAITGMDATFGALKGLDAFERAIYTGAHGAIPLPEKRWRFLGKDKDFLDLCGVKATPHGCYIEDVEVDFQRLRTPMTPEDMLLPQQLLAVTTIDRAILDSGMKKGGNVAVFVGLGTDLELYRHRARVALKERVRPEASKKLNDMMQYINDCGTSTSYTSYIGNLVATRVSSQWGFTGPSFTITEGNNSVYRCAELGKYLLETGEVDGVVVAGVDLCGSAENLYVKSRRFKVSTSDTPRASFDAAADGYFVGEGCGAFVLKRETSCTKDDRIYACMDAIVPGNVPSACLREALDQARVKPGDIEMLELSADSARHLKDPSVLPKELTAEEEIGGLQTILRDDDKLPRNVATGSVKATVGDTGYASGAASLIKAALCIYNRYLPSNGDDWDEPAPEAPWDSTLFACQTSRAWLKNPGERRYAAVSGVSETRSCYSVLLSEAEGHYERENRISLDEEAPKLIVLRADSHEEILGRLDKIRERFLQPTGAAPRESELKAQARRIFLELLGETLAQDAASSGSQKPLALSLVSTPSKLQREVELAAKGIPRCLKMRRDWSSPAGSRYAPEPLASDRVAFMYGEGRSPYYGITQDIHRIWPELHEVINEKTNRLWAEGDRWVMPRASFKSELESQQQEFDRNMIEMFRLGILTSIAFTNLARDVLNITPKAAFGLSLGEISMIFAFSKKNGLISDQLTKDLRESDVWNKALAVEFNALREAWGIPQSVPKDEFWQGYIVRGTKQDIEAAIAPDSKYVRLTIINDANTALISGKPDACKAAIARLGGNIPALPVTQGMCGHCPEVGPYTKDIAKIHANLEFPVVDGLDLWTTINQKRLVPRATGAKDEWAPSSFGEYAGQLYEKQANFPQIVETIYKQNYDVFVEVGPNNHRSTAVRTTLGPQRNHLAGAIDKQNEDAWTTIVKLVASLKAHLVPGVTISPLYHSKLVAEAEACYAALCKGEKPKKNKFVRKIQLNGRFNSKADPISSADLASFPPADPAIEAAISSRIMKPVAPKFYARLNIDEQDETRDPILNKDNAPSSSSSSSSSSSSSSSPSPAPSAPVQKKAAPAAETKAVASADALRSALLDLDSMLALSSASASGNLVETAPSDASVIVPPCNIADLGSRAFMKTYGVSAPLYTGAMAKGIASADLVIAAGRQGILASFGAGGLPMQVVRESIEKIQAALPNGPYAVNLIHSPFDSNLEKGNVDLFLEKGVTFVEASAFMTLTPQVVRYRAAGLTRNADGSVNIRNRIIGKVSRTELAEMFMRPAPEHLLQKLIASGEINQEQAELARRVPVADDIAVEADSGGHTDNRPIHVILPLIINLRDRLHRECGYPANLRVRVGAGGGIGCPQAALATFNMGASFIVTGTVNQVAKQSGTCDNVRKQLAKATYSDVCMAPAADMFEEGVKLQVLKKGTMFPSRANKLYELFCKYDSFESMPPAELARVEKRIFSRALEEVWDETKNFYINRLHNPEKIQRAERDPKLKMSLCFRWYLSLASRWANTGASDRVMDYQVWCGPAIGSFNDFIKGTYLDPAVANEYPCVVQINKQILRGACFLRRLEILRNARLSDGAAALVASIDDTYVPAEKL

SEQ ID NO: 87 - DNA, 4509 bp, Schizochytorium sp.
  CDS (1)..(4509)
atggcgctccgtgtcaagacgaacaagaagccatgctgggagatgaccaaggaggagctgaccagcggcaagaccgaggtgttcaactatgaggaactcctcgagttcgcagagggcgacatcgccaaggtcttcggacccgagttcgccgtcatcgacaagtacccgcgccgcgtgcgcctgcccgcccgcgagtacctgctcgtgacccgcgtcaccctcatggacgccgaggtcaacaactaccgcgtcggcgcccgcatggtcaccgagtacgatctccccgtcaacggagagctctccgagggcggagactgcccctgggccgtcctggtcgagagtggccagtgcgatctcatgctcatctcctacatgggcattgacttccagaaccagggcgaccgcgtctaccgcctgctcaacaccacgctcaccttttacggcgtggcccacgagggcgagaccctcgagtacgacattcgcgtcaccggcttcgccaagcgtctcgacggcggcatctccatgttcttcttcgagtacgactgctacgtcaacggccgcctcctcatcgagatgcgcgatggctgcgccggcttcttcaccaacgaggagctcgacgccggcaagggcgtcgtcttcacccgcggcgacctcgccgcccgcgccaagatcccaaagcaggacgtctccccctacgccgtcgccccctgcctccacaagaccaagctcaacgaaaaggagatgcagaccctcgtcgacaaggactgggcatccgtctttggctccaagaacggcatgccggaaatcaactacaaactctgcgcgcgtaagatgctcatgattgaccgcgtcaccagcattgaccacaagggcggtgtctacggcctcggtcagctcgtcggtgaaaagatcctcgagcgcgaccactggtactttccctgccactttgtcaaggatcaggtcatggccggatccctcgtctccgacggctgcagccagatgctcaagatgtacatgatctggctcggcctccacctcaccaccggaccctttgacttccgcccggtcaacggccaccccaacaaggtccgctgccgcggccaaatctccccgcacaagggcaagctcgtctacgtcatggagatcaaggagatgggcttcgacgaggacaacgacccgtacgccattgccgacgtcaacatcattgatgtcgacttcgaaaagggccaggactttagcctcgaccgcatcagcgactacggcaagggcgacctcaacaagaagatcgtcgtcgactttaagggcatcgctctcaagatgcagaagcgctccaccaacaagaacccctccaaggttcagcccgtctttgccaacggcgccgccactgtcggccccgaggcctccaaggcttcctccggcgccagcgccagcgccagcgccgccccggccaagcctgccttcagcgccgatgttcttgcgcccaagcccgttgcccttcccgagcacatcctcaagggcgacgccctcgcccccaaggagatgtcctggcaccccatggcccgcatcccgggcaacccgacgccctcttttgcgccctcggcctacaagccgcgcaacatcgcctttacgcccttccccggcaaccccaacgataacgaccacaccccgggcaagatgccgctcacctggttcaacatggccgagttcatggccggcaaggtcagcatgtgcctcggccccgagttcgccaagttcgacgactcgaacaccagccgcagccccgcttgggacctcgctctcgtcacccgcgccgtgtctgtgtctgacctcaagcacgtcaactaccgcaacatcgacctcgacccctccaagggtaccatggtcggcgagttcgactgccccgcggacgcctggttctacaagggcgcctgcaacgatgcccacatgccgtactcgatcctcatggagatcgccctccagacctcgggtgtgctcacctcggtgctcaaggcgcccctgaccatggagaaggacgacatcctcttccgcaacctcgacgccaacgccgagttcgtgcgcgccgacctcgactaccgcggcaagactatccgcaacgtcaccaagtgcactggctacagcatgctcggcgagatgggcgtccaccgcttcacctttgagctctacgtcgatgatgtgctcttttacaagggctcgacctcgttcggctggttcgtgcccgaggtctttgccgcccaggccggcctcgacaacggccgcaagtcggagccctggttcattgagaacaaggttccggcctcgcaggtctcctcctttgacgtgcgccccaacggcagcggccgcaccgccatcttcgccaacgcccccagcggcgcccagctcaaccgccgcacggaccagggccagtacctcgacgccgtcgacattgtctccggcagcggcaagaagagcctcggctacgcccacggttccaagacggtcaacccgaacgactggttcttctcgtgccacttttggtttgactcggtcatgcccggaagtctcggtgtcgagtccatgttccagctcgtcgaggccatcgccgcccacgaggatctcgctggcaagcacggcattgccaaccccacctttgtgcacgccccgggcaagatcagctggaagtaccgcggccagctcacgcccaagagcaagaagatggactcggaggtccacatcgtgtccgtggacgcccacgacggcgttgtcgacctcgtcgccgacggcttcctctgggccgacagcctccgcgtctactcggtgagcaacattcgcgtgcgcatcgcctccggtgaggcccctgccgccgcctcctccgccgcctctgtgggctcctcggcttcgtccgtcgagcgcacgcgctcgagccccgctgtcgcctccggcccggcccagaccatcgacctcaagcagctcaagaccgagctcctcgagctcgatgccccgctctacctctcgcaggacccgaccagcggccagctcaagaagcacaccgacgtggcctccggccaggccaccatcgtgcagccctgcacgctcggcgacctcggtgaccgctccttcatggagacctacggcgtcgtcgccccgctgtacacgggcgccatggccaagggcattgcctcggcggacctcgtcatcgccgccggcaagcgcaagatcctcggctcctttggcgccggcggcctccccatgcaccacgtgcgcgccgccctcgagaagatccaggccgccctgcctcagggcccctacgccgtcaacctcatccactcgccttttgacagcaacctcgagaagggcaacgtcgatctcttcctcgagaagggcgtcactgtggtggaggcctcggcattcatgaccctcaccccgcaggtcgtgcgctaccgcgccgccggcctctcgcgcaacgccgacggttcggtcaacatccgcaaccgcatcatcggcaaggtctcgcgcaccgagctcgccgagatgttcatccgcccggccccggagcacctcctcgagaagctcatcgcctcgggcgagatcacccaggagcaggccgagctcgcgcgccgcgttcccgtcgccgacgatatcgctgtcgaggctgactcgggcggccacaccgacaaccgccccatccacgtcatcctcccgctcatcatcaacctccgcaaccgcctgcaccgcgagtgcggctaccccgcgcacctccgcgtccgcgttggcgccggcggtggcgtcggctgcccgcaggccgccgccgccgcgctcaccatgggcgccgccttcatcgtcaccggcactgtcaaccaggtcgccaagcagtccggcacctgcgacaacgtgcgcaagcagctctcgcaggccacctactcggatatctgcatggccccggccgccgacatgttcgaggagggcgtcaagctccaggtcctcaagaagggaaccatgttcccctcgcgcgccaacaagctctacgagctcttttgcaagtacgactccttcgactccatgcctcctgccgagctcgagcgcatcgagaagcgtatcttcaagcgcgcactccaggaggtctgggaggagaccaaggacttttacattaacggtctcaagaacccggagaagatccagcgcgccgagcacgaccccaagctcaagatgtcgctctgcttccgctggtaccttggtcttgccagccgctgggccaacatgggcgccccggaccgcgtcatggactaccaggtctggtgtggcccggccattggcgccttcaacgacttcatcaagggcacctacctcgaccccgctgtctccaacgagtacccctgtgtcgtccagatcaacctgcaaatcctccgtggtgcctgctacctgcgccgtctcaacgccctgcgcaacgacccgcgcattgacctcgagaccgaggatgctgcctttgtctacgagcccaccaacgcgctctaa

SEQ ID NO: 88 - protein, 1502 aa, Schizochytorium sp.
MALRVKTNKKPCWEMTKEELTSGKTEVFNYEELLEFAEGDIAKVFGPEFAVIDKYPRRVRLPAREYLLVTRVTLMDAEVNNYRVGARMVTEYDLPVNGELSEGGDCPWAVLVESGQCDLMLISYMGIDFQNQGDRVYRLLNTTLTFYGVAHEGETLEYDIRVTGFAKRLDGGISMFFFEYDCYVNGRLLIEMRDGCAGFFTNEELDAGKGVVFTRGDLAARAKIPKQDVSPYAVAPCLHKTKLNEKEMQTLVDKDWASVFGSKNGMPEINYKLCARKMLMIDRVTSIDHKGGVYGLGQLVGEKILERDHWYFPCHFVKDQVMAGSLVSDGCSQMLKMYMIWLGLHLTTGPFDFRPVNGHPNKVRCRGQISPHKGKLVYVMEIKEMGFDEDNDPYAIADVNIIDVDFEKGQDFSLDRISDYGKGDLNKKIVVDFKGIALKMQKRSTNKNPSKVQPVFANGAATVGPEASKASSGASASASAAPAKPAFSADVLAPKPVALPEHILKGDALAPKEMSWHPMARIPGNPTPSFAPSAYKPRNIAFTPFPGNPNDNDHTPGKMPLTWFNMAEFMAGKVSMCLGPEFAKFDDSNTSRSPAWDLALVTRAVSVSDLKHVNYRNIDLDPSKGTMVGEFDCPADAWFYKGACNDAHMPYSILMEIALQTSGVLTSVLKAPLTMEKDDILFRNLDANAEFVRADLDYRGKTIRNVTKCTGYSMLGEMGVHRFTFELYVDDVLFYKGSTSFGWFVPEVFAAQAGLDNGRKSEPWFIENKVPASQVSSFDVRPNGSGRTAIFANAPSGAQLNRRTDQGQYLDAVDIVSGSGKKSLGYAHGSKTVNPNDWFFSCHFWFDSVMPGSLGVESMFQLVEAIAAHEDLAGKHGIANPTFVHAPGKISWKYRGQLTPKSKKMDSEVHIVSVDAHDGVVDLVADGFLWADSLRVYSVSNIRVRIASGEAPAAASSAASVGSSASSVERTRSSPAVASGPAQTIDLKQLKTELLELDAPLYLSQDPTSGQLKKHTDVASGQATIVQPCTLGDLGDRSFMETYGVVAPLYTGAMAKGIASADLVIAAGKRKILGSFGAGGLPMHHVRAALEKIQAALPQGPYAVNLIHSPFDSNLEKGNVDLFLEKGVTVVEASAFMTLTPQVVRYRAAGLSRNADGSVNIRNRIIGKVSRTELAEMFIRPAPEHLLEKLIASGEITQEQAELARRVPVADDIAVEADSGGHTDNRPIHVILPLIINLRNRLHRECGYPAHLRVRVGAGGGVGCPQAAAAALTMGAAFIVTGTVNQVAKQSGTCDNVRKQLSQATYSDICMAPAADMFEEGVKLQVLKKGTMFPSRANKLYELFCKYDSFDSMPPAELERIEKRIFKRALQEVWEETKDFYINGLKNPEKIQRAEHDPKLKMSLCFRWYLGLASRWANMGAPDRVMDYQVWCGPAIGAFNDFIKGTYLDPAVSNEYPCVVQINLQILRGACYLRRLNALRNDPRIDLETEDAAFVYEPTNAL

SEQ ID NO: 89 - DNA, 6105 bp, Aurantiochytrium sp. OH4
  CDS (1)..(6105)
atggcctctcgcaagaatgtgagcgctgctcacgaaatgcacgacgagaagcgcattgccgtggtgggcatggccgtgcaatacgcgggctgcaaagacaaggaagagttctggaaagtagtcatgggcggtgaggctgcatggactaagattagcgataaacgcctcggatccaacaagcgagccgagcacttcaaagcagagcgtagcaaatttgcagataccttttgcaacgagaactacggctgcgtcgatgactccgtcgataacgaacacgagcttctcctcaagctctccaagaaggctctctccgagacatcggtctccgactctacaaggtgcggtattgtgagcggatgcctgtcctttcccatggacaacctccagggcgaactcctcaatgtgtaccaaaaccacgtcgaaaagaaactcggcgctcgcgtcttcaaggatgcctccaagtggtccgagcgtgagcagtcgcagaaccccgaggctggtgaccgccgcatctttatggacccggcatccttcgtagcagaagagcttaacctcggtcctcttcactactctgtcgatgctgcctgtgccaccgccctttacgtccttcgcctcgcccaggaccacctcgtttccggtgctgctgatgtcatgctcgctggtgcaacttgcttcccggagccctttttcattctctccggattctccactttccaggccatgcctgtatcgggagacggcatctcgtacccgcttcacaaggacagtcagggtctcacccctggtgaaggtggtgccattatggttctcaagcgccttgacgacgctattcgcgatggagaccacatttacggtactctgctcggtgctaccatcagcaatgctggctgtggtcttcccctcaagccacacttgcccagcgagaagtcctgcctcattgatacctacaagcgcgtcaacgtgcacccgcacaagatccagtacgtcgagtgccacgcaacgggtactccccagggagaccgcgttgagattgatgccgtcaaggcttgcttcgagggcaaggtgcctcgctttggaagctccaagggtaactttggccacacactcgttgcagctggtttcgcaggcatgtgcaaggtactccttgccatgaagcatggtgtgatcccgcccactcctggtgtcgatggatcttcccaaatggacccgcttgtggtctctgagcccatcccatggcccgacactgagggcgagcccaagcgcgctggtctctccgctttcggctttggtggcaccaacgcccacgcagtctttgaggagtttgaccgctccaaggctgcctgtgccacccacgatagcatcagttccctcagctcacgttgtggcggggagggcaacatgcgcattgctattaccggtatggatgccaccttcggctccctcaagggcctggacgcctttgagcgtgccatctacaatggccaacatggtgctgtgccattgcctgagaagcgctggcgtttccttggtaaagacaaggactttttggacctgtgcggcgtcaaggaggtgccccacggatgctacattgaggacgtcgaggtggactttagccgcctgcgcacgcccatgacgccagacgacatgttgcgccccatgcagctacttgctgtcacaaccatcgaccgtgccattctcaactctggcctcaagaagggaggtaaggtcgctgtcttcgtcggccttggcactgaccttgagctctaccgtcaccgcgcccgcgttgccctcaaggagcgtgctcgtcccgaagccgctgcagccctcaatgatatgatgtcctacatcaacgattgcggtaccgctacctcgtacacatcctacatcggcaacctcgtggccacccgcgtgtcttcacaatggggtttcgagggtccttctttcaccatcacagagggcaacaactccgtctaccgttgcgcagagttgggcaagtacttgctcgagactggcgaggtcgaggccgtagtgatcgccggtgtggatctttgcgccagcgctgagaatctctacgtgaagtcgcgtcgtttcaaggtctcggagcaggagagcccgcgggccagcttcgactccggcgctgacggctactttgttggtgagggatgtggtgccctcgtcctcaagcgcgagagcgactgcaccaaggacgaacgcatttacgcctgcatggacgctatcgtgcccggcaacatgccggcagcctgcatggaggaggctctcgcccaggctcgcgtcaaccccaaggacgttgagatgctcgagctctccgctgactctgcccgccacctcaagaacccctccgttctgcctaaggaactcactgctgaggaggaaatccgcggcattgaggccattctcagccagcgctctagcaacgaagctgtggagccccacaacgtcgctgtcagcagcgtcaagtccactgtcggtgacaccggctacgcctcaggagctgccagtctcatcaagacggctctctgtctgtacaaccgctacttgccctcaaacggcgcctcctgggaggagcctgcacctgagacacagtggggcaagtctctgtacgcgtgccagtcctcgcgggcctggttgaagaaccctggagctcgccgccacgcagctgtctcaggtgtttccgagacccgttcatgctacacggtgctgctctctgatgtggagggccaccacgagaccaagagccgcatttcgctcgatgacgatgccgtcaaactcctcgtaatccgcggagactcccacgacgctatcacgcagcgtgttgacaagctccgcgagcgcctcgcccagcctagcgctaatgtacgtcttgcttttatggagttgctcggcgagagcattgcccaggagaccaagaccccgttgccggccttcgctctgtgcctggtgacctctcctagtaagctccagaaggagcttgaactcgcctccaagggcatcccgcggagtcttaagatgggccgcgactggacatcaccctcgggcagccactttgcacccaagccactgtcaagcgatcgcgttgcgtttatgtacggcgaaggccgaagcccttactatggtatcggccttgacattcaccgcatctggcccgaacttcacgagtttgtaaacgccaagaccaacaagctttgggatcaaggcgacagatggttgatcccgcgcgcctcgacgaaggaggagcttaaggcgcaggaagatgagttcagccgcaaccaggtggagatgttccgactcggtattctcatgtccatgtgcttcacccacatcgctcgtgacgtgcttggcatccagcccaaggctgctttcggactgagccttggagagatttccatggtttttgccttttctgagaagaacggccttgtctctgaggagctgacaactaaactccgcaactcggaggtctggcgtaaggccctcgctgttgagtttgacgccctccgcaaggcctggaatattccccaagatacccctgtcagcgagttctggcaaggatacgtggtacgtggaacccgcgaggccgttgaagcggccatcggccccaacaataagtacgtgcacttgaccattgtcaacgatgccaacagtgctctcatcagtggcaagcctgaagattgcaaggctgccattgctcgcctgagcagcaacctccctgctttgcccgtggaccttggtatgtgtggccactgccccgtggtcgagccgtacggcaagcagatcgctgagatccatagcgtcctcgagattcccgaggttgccggccttgacctgtacacgagcgtcaaccagaagaagcttgttaacaagtccactggagccagcgacgagtacgcacccagctttggtgaatacgcagcacagctgtacactgttcaggcagactttcctaagatcgccaagaccgttagcgacaagaactttgacgtctttgttgagactggtcccaacgctcaccgtagcgccgcaattcgcgccacccttggaaatagcaagccttttgtcaccggatccatggaccgccagaacgagaatgcttggacaaccatggtcaagctggttgcctctctccaagcccaccgcgtgcctggcgtgaaggtctcccctctgtaccaccccgagactgttgaggaggctacgcagagttacaacgatatggtggctggcaagaagcctactaagaacaagttcttgcgtaagattgtggtcaatggtcgctatgaccccaaaaagcagctcgtgccgccccaggtgctagctaagcttcctcctgcggaccccaagatcgaggctcttatccaggctcgcaagatgcagcctattgcccccaagttcatggagcgtctcgacattcaggagcaagacgccacacgcgaccctattctcaacaaggataacaaaccttccgctgctcctgcccttgtccctgctgctccggcccctgctccggcccgcagcgcctccggagctgttgtggcttcctctgaggctctccgtgccaaacttttggagctcaacagcactttgatgcttggtgtcaacgccaacggtgatctcgttgaagcaagcccaagtgaagcatctattgttgtgcccaagtgcgatatcaaggatcttggcagccgtgccttcatggagacatatggtgtatccgcccccatgtacaccggcgccatggcaaagggcattgcatccgctgagatggttatcgctgccggaaagcgcggcatccttggttctctcggtgctggtggtcttcctatcgccaccgtacgcaaggctctcgaagctatccaggctgaactgcccaagggcccttacgctgtcaacctcatccactctcccttcgacagcaacctcgagaagggtaacgtcgacctcttcctcgagaagggcgtcactgtcgttgaagcctccgcctttatgaccttgaccccgcagctcgtgcgctaccgtgctgcaggtctctctcgcgctgctgatggctccacggttattaagaaccgcgtcatcggtaaggtttctcgcacagagcttgccgcaatgtttatccgtcccgcgcccgagaatctcctcgagaagctgctgaagtccggcgagatcacccaagagcaggctgctctcgcacgcacagtgcctgtggcagacgacattgccgttgaggcggactccggtggccacaccgataaccgccccatccacgtcatcctccctctcattgtcaacctccgtgatcgtctgcacaaggagtgcggctaccctgcccaccttcgcgttcgcgttggtgctggtggtggcattggatgccctcaggccgccattgccaccttcaacatgggcgcggccttcatcgtcactggtaccgtaaaccagatgagtaagcaagctggaacctgtgacaccgttcgcaagcagctctcacaagccacctactccgacatctgcatggccccagcagctgacatgtttgaggaaggtgtcaagctccaggtgctcaagaagggaactatgttcccctcgcgtgccaacaagctctatgagctcttcgtcaagtatgactcctttgagtccatggctcctggagagctggaacgtgtggagaagcgcattttcaagaagtctctgtcagaggtttgggaagagaccaaggacttctacatcaacaggttgcagaacccggagaagattgagcgcgcggagcgtgaccccaagcttaagatgtccttgtgcttccgctggtaccttggtttggcgagcttctgggcaaacgctggcatcccggaccgtgccatggactaccaggtttggtgtggcccagcgattggatctttcaacgacttcatcaagggtacctaccttgaccccgccgttgccaacgagtaccccgatgttgtgcaaatcaacttgcagatcctccgtggtgcctgcttcttgcgccgcctcgaagctgtccgtaatgccccgctgaaggctaacgccaagcaggttgctgccgagattgatgacatctacgtgcccactgagcgcctgtaa

SEQ ID NO: 90 - protein, 2034 aa, Aurantiochytrium sp. OH4
MASRKNVSAAHEMHDEKRIAVVGMAVQYAGCKDKEEFWKVVMGGEAAWTKISDKRLGSNKRAEHFKAERSKFADTFCNENYGCVDDSVDNEHELLLKLSKKALSETSVSDSTRCGIVSGCLSFPMDNLQGELLNVYQNHVEKKLGARVFKDASKWSEREQSQNPEAGDRRIFMDPASFVAEELNLGPLHYSVDAACATALYVLRLAQDHLVSGAADVMLAGATCFPEPFFILSGFSTFQAMPVSGDGISYPLHKDSQGLTPGEGGAIMVLKRLDDAIRDGDHIYGTLLGATISNAGCGLPLKPHLPSEKSCLIDTYKRVNVHPHKIQYVECHATGTPQGDRVEIDAVKACFEGKVPRFGSSKGNFGHTLVAAGFAGMCKVLLAMKHGVIPPTPGVDGSSQMDPLVVSEPIPWPDTEGEPKRAGLSAFGFGGTNAHAVFEEFDRSKAACATHDSISSLSSRCGGEGNMRIAITGMDATFGSLKGLDAFERAIYNGQHGAVPLPEKRWRFLGKDKDFLDLCGVKEVPHGCYIEDVEVDFSRLRTPMTPDDMLRPMQLLAVTTIDRAILNSGLKKGGKVAVFVGLGTDLELYRHRARVALKERARPEAAAALNDMMSYINDCGTATSYTSYIGNLVATRVSSQWGFEGPSFTITEGNNSVYRCAELGKYLLETGEVEAVVIAGVDLCASAENLYVKSRRFKVSEQESPRASFDSGADGYFVGEGCGALVLKRESDCTKDERIYACMDAIVPGNMPAACMEEALAQARVNPKDVEMLELSADSARHLKNPSVLPKELTAEEEIRGIEAILSQRSSNEAVEPHNVAVSSVKSTVGDTGYASGAASLIKTALCLYNRYLPSNGASWEEPAPETQWGKSLYACQSSRAWLKNPGARRHAAVSGVSETRSCYTVLLSDVEGHHETKSRISLDDDAVKLLVIRGDSHDAITQRVDKLRERLAQPSANVRLAFMELLGESIAQETKTPLPAFALCLVTSPSKLQKELELASKGIPRSLKMGRDWTSPSGSHFAPKPLSSDRVAFMYGEGRSPYYGIGLDIHRIWPELHEFVNAKTNKLWDQGDRWLIPRASTKEELKAQEDEFSRNQVEMFRLGILMSMCFTHIARDVLGIQPKAAFGLSLGEISMVFAFSEKNGLVSEELTTKLRNSEVWRKALAVEFDALRKAWNIPQDTPVSEFWQGYVVRGTREAVEAAIGPNNKYVHLTIVNDANSALISGKPEDCKAAIARLSSNLPALPVDLGMCGHCPVVEPYGKQIAEIHSVLEIPEVAGLDLYTSVNQKKLVNKSTGASDEYAPSFGEYAAQLYTVQADFPKIAKTVSDKNFDVFVETGPNAHRSAAIRATLGNSKPFVTGSMDRQNENAWTTMVKLVASLQAHRVPGVKVSPLYHPETVEEATQSYNDMVAGKKPTKNKFLRKIVVNGRYDPKKQLVPPQVLAKLPPADPKIEALIQARKMQPIAPKFMERLDIQEQDATRDPILNKDNKPSAAPALVPAAPAPAPARSASGAVVASSEALRAKLLELNSTLMLGVNANGDLVEASPSEASIVVPKCDIKDLGSRAFMETYGVSAPMYTGAMAKGIASAEMVIAAGKRGILGSLGAGGLPIATVRKALEAIQAELPKGPYAVNLIHSPFDSNLEKGNVDLFLEKGVTVVEASAFMTLTPQLVRYRAAGLSRAADGSTVIKNRVIGKVSRTELAAMFIRPAPENLLEKLLKSGEITQEQAALARTVPVADDIAVEADSGGHTDNRPIHVILPLIVNLRDRLHKECGYPAHLRVRVGAGGGIGCPQAAIATFNMGAAFIVTGTVNQMSKQAGTCDTVRKQLSQATYSDICMAPAADMFEEGVKLQVLKKGTMFPSRANKLYELFVKYDSFESMAPGELERVEKRIFKKSLSEVWEETKDFYINRLQNPEKIERAERDPKLKMSLCFRWYLGLASFWANAGIPDRAMDYQVWCGPAIGSFNDFIKGTYLDPAVANEYPDVVQINLQILRGACFLRRLEAVRNAPLKANAKQVAAEIDDIYVPTERL

SEQ ID NO: 91 - DNA, 4302 bp, Aurantiochytrium sp. OH4
  CDS (1)..(4302)
atggccactcgcgtgaagaccaacaagaaaccatgctgggagatgaccaaggaggagctcaccagcggcaagaacgtcgttttcgactatgacgagctccttgagttcgccgagggtgacatcagcaaggtcttcggccccgaattcagccagatcgaccagtacaagcgtcgcgttcgtctccccgcccgcgagtacctcctcgtcacccgcgtcaccctcatggacgccgaggtcaacaactaccgcgtcggtgcccgcatggtcactgagtacgacctccccgtcaacggtgagctctctgagggtggtgactgcccctgggccgtgctcgtcgagagtggccagtgtgatctcatgctcatctcctacatgggtattgacttccagaacaagagcgaccgcgtctaccgtctgctcaacaccaccctcaccttctacggtgttgcccaggagggcgagaccctggagtacgatatccgcgtgaccggcttcgccaagcgtctcgacggtgacatctccatgttcttcttcgagtacgactgctacgtcaacggccgtctcctcatcgagatgcgcgacggctgtgccggtttcttcaccaacgaggagctcgccgccggcaagggtgtcgtctttacccgcgctgatctcctcgcccgcgagaagaccaagaagcaggacatcaccccgtacgccattgccccgcgtcttaacaagaccgttctcaacgagactgagatgcagtccctcgtggacaagaactggaccaaggttttcggccccgagaacggcatggaccagatcaactacaaactctgcgcccgtaagatgctcatgattgaccgcgtcaccaagattgactacaccggtggcccctacggccttggtctcctcgttggtgagaagatcctcgagcgcgaccactggtacttcccgtgccacttcgtcggagaccaggtcatggctggatccctcgtgtctgacggctgcagccagctcctcaagatgtacatgctctggctcggcctccaccttaagaccggtcccttcgacttccgccccgtcaacggccaccccaacaaggtccgctgccgtggccagatctccccgcacaagggtaagctcgtctacgtcatggagatcaaggagatgggatacgacgaggctggtgacccgtacgccattgccgatgtcaacattctcgacattgacttcgagaagggccagactttcgaccttgccaacctccacgagtacggcaagggcgacctcaacaagaagatcgtcgtcgacttcaagggtattgccctcaagctccagaagcgctctggccctgccgttgtcgctcccgagaagcccctcgctctcaacaaggacctttgcgccccggctgttgaggccatccctgagcacatcctcaagggcgatgctcttgcccctaaccagatgacctggcacccgatgtccaagatcgctggcaaccccacgccctcgttctctccctcggcctaccctccccgtcccatcaccttcaccccgttccccggcaacaagaacgacaacaaccacgtgcccggcgagatgccgctctcgtggtacaacatggctgagttcatggccggcaaggtcagcctctgcctcggccctgagttcgccaagttcgatgactccaacaccagccgcagccctgcatgggatcttgctcttgtgactcgtgtggtctccgtttctgacatggagtgggtccagtggaagaacgtggactgcaacccgtccaagggaaccatggttggcgagttcgactgccccatcgacgcctggttcttccagggatcttgtaacgacggccacatgccgtactccatcctcatggagatcgccctccagacctctggtgtcctcacctctgtgctcaaggccccgctcaccatggagaagaaggacattctcttccgcaaccttgacgccaacgccgagatggttcgctctgatattgacctccgcggcaagaccatccacaacctcaccaagtgtaccggctacagcatgctcggagacatgggtgtccaccgcttcagcttcgagctctctgttgatggtgtagtcttctacaagggtaccacctccttcggctggttcgtccctgaggtcttcatctcccagactggtctcgacaacggtcgccgcacccagccctggcacattgagtccaaggtgccttccgcccaggtcctcacctacgacgttacccccaacggtgccggtcgcacccagctctacgccaacgctcccaagggtgctcagctcagtcgccgctggaaccagtgccagtaccttgacaccatcgaccttgtggtcgccggtggctccgccggtcttggctacggtcatggccgcaagcaggtgaaccccaaggactggttcttctcgtgccacttctggttcgactccgtcatgcccggctcgctcggtgtggagtctatgttccagctcgtcgagtccatcgctgtcaagcaggacctcgccggcaagtacggcatcaccaacccgaccttcgctcatgctccgggcaagatctcctggaagtaccgtggtcagctcacccccacctccaagttcatggactccgaggcccacattgtctccatcgaggcccacgacggcgtcgtcgacatcgttgccaatggtaacctctgggctgatggcctccgcgtctacaacgtcagcaacatccgtgttcgcattaccatcaccctcaagcagctcaaggctgagcttcttgacgttgagaagcctctctacatctcctccagcaacggccaggtcaagaagcacgccgatgtggctggtggccaggccaccattgtgcaggcttgcagcctcagtgacctcggtgatgaaggcttcatgaagacctacggtgttgtggctcctctctacaccggtgccatggccaagggtattgcctctgctgaccttgtgattgccactggtaagcgtaagatcctcggttccttcggtgctggtggtctccccatgcacattgtccgtgccgctgttgagaagatccaggctgagctcccgaacggccccttcgccgtcaacctcatccactcccccttcgatagcaaccttgagaagggcaacgttgacctcttcctcgagaagggcgtcactgtcgtcgaggcctccgccttcatgaccttgaccccgcaagtcgtccgctaccgtgctgctggtctttcccgtaacgctgatggctccattaacatcaagaaccgcatcatcggtaaggtctcccgtaccgagctcgctgagatgttcatccgccctgccccgcagaacctcctcgacaagctcatccagtctggtgagattaccaaggagcaggctgagcttgccaagctcgtccccgtcgccgacgatatcgccgtcgaggccgactctggtggccacaccgacaaccgccccatccacgtcatcctcccccttatcatcaacctccgcaaccgcctccacaaggagtgcggctaccccgctcacctccgcgtgcgcgttggagctggtggtggtgttggatgcccccaggccgctgccgctgctctcgctatgggtgctgccttccttgttaccggcactgtcaaccaggtcgccaagcagtccggcacctgcgacaatgtccgcaagcagctctgcatggccacctactctgacgtctgcatggctcccgctgctgacatgttcgaggagggcgtcaagctccaggtcctcaagaagggaaccatgttcccgtccagggctaacaagctctacgagctcttctgcaagtacgactccttcgagtccatgcctgccgcagagctcgagcgtgttgagaagcgcatcttccagtgccctcttgctgatgtctgggctgagacctccgacttctacatcaaccgcctccacaacccggagaagatcacccgtgccgagcgtgaccccaagctcaagatgtctctctgcttccgctggtaccttggtcttgcctctcgctgggccaacaccggtgaggctggacgcgtcatggactaccaggtctggtgtggccctgccattggagccttcaacgacttcatcaagggctcctaccttgacccggccgtctctggtgagtacccggacgtcgtgcagatcaacttgcagatccttcgcggtgcctgctacctccgccgtctcaatgccatccgcaacgacccgcgtgtcagcattgaggtcgaggatgctgagttcgtctacgagcccaccaacgccctctaa

SEQ ID NO: 92 - protein, 1433 aa, Aurantiochytrium sp. OH4
MATRVKTNKKPCWEMTKEELTSGKNVVFDYDELLEFAEGDISKVFGPEFSQIDQYKRRVRLPAREYLLVTRVTLMDAEVNNYRVGARMVTEYDLPVNGELSEGGDCPWAVLVESGQCDLMLISYMGIDFQNKSDRVYRLLNTTLTFYGVAQEGETLEYDIRVTGFAKRLDGDISMFFFEYDCYVNGRLLIEMRDGCAGFFTNEELAAGKGVVFTRADLLAREKTKKQDITPYAIAPRLNKTVLNETEMQSLVDKNWTKVFGPENGMDQINYKLCARKMLMIDRVTKIDYTGGPYGLGLLVGEKILERDHWYFPCHFVGDQVMAGSLVSDGCSQLLKMYMLWLGLHLKTGPFDFRPVNGHPNKVRCRGQISPHKGKLVYVMEIKEMGYDEAGDPYAIADVNILDIDFEKGQTFDLANLHEYGKGDLNKKIVVDFKGIALKLQKRSGPAVVAPEKPLALNKDLCAPAVEAIPEHILKGDALAPNQMTWHPMSKIAGNPTPSFSPSAYPPRPITFTPFPGNKNDNNHVPGEMPLSWYNMAEFMAGKVSLCLGPEFAKFDDSNTSRSPAWDLALVTRVVSVSDMEWVQWKNVDCNPSKGTMVGEFDCPIDAWFFQGSCNDGHMPYSILMEIALQTSGVLTSVLKAPLTMEKKDILFRNLDANAEMVRSDIDLRGKTIHNLTKCTGYSMLGDMGVHRFSFELSVDGVVFYKGTTSFGWFVPEVFISQTGLDNGRRTQPWHIESKVPSAQVLTYDVTPNGAGRTQLYANAPKGAQLSRRWNQCQYLDTIDLVVAGGSAGLGYGHGRKQVNPKDWFFSCHFWFDSVMPGSLGVESMFQLVESIAVKQDLAGKYGITNPTFAHAPGKISWKYRGQLTPTSKFMDSEAHIVSIEAHDGVVDIVANGNLWADGLRVYNVSNIRVRITITLKQLKAELLDVEKPLYISSSNGQVKKHADVAGGQATIVQACSLSDLGDEGFMKTYGVVAPLYTGAMAKGIASADLVIATGKRKILGSFGAGGLPMHIVRAAVEKIQAELPNGPFAVNLIHSPFDSNLEKGNVDLFLEKGVTVVEASAFMTLTPQVVRYRAAGLSRNADGSINIKNRIIGKVSRTELAEMFIRPAPQNLLDKLIQSGEITKEQAELAKLVPVADDIAVEADSGGHTDNRPIHVILPLIINLRNRLHKECGYPAHLRVRVGAGGGVGCPQAAAAALAMGAAFLVTGTVNQVAKQSGTCDNVRKQLCMATYSDVCMAPAADMFEEGVKLQVLKKGTMFPSRANKLYELFCKYDSFESMPAAELERVEKRIFQCPLADVWAETSDFYINRLHNPEKITRAERDPKLKMSLCFRWYLGLASRWANTGEAGRVMDYQVWCGPAIGAFNDFIKGSYLDPAVSGEYPDVVQINLQILRGACYLRRLNAIRNDPRVSIEVEDAEFVYEPTNAL

SEQ ID NO: 93 - DNA, 714 bp, Nostoc sp. PCC7120
  CDS (1)..(714)
atgctgcaacatacctggctgccgaaaccgcctaatctgaccctgctgagtgatgaagttcatctgtggcgtattccgctggatcagccggaaagccagctgcaagacctggcagcaaccctgagcagtgatgaactggcacgtgcaaatcgtttctattttccggaacatcgtcgtcgttttaccgcaggtcgtggtattctgcgtagcattctgggtggttatctgggtgttgaaccgggtcaggttaaatttgattatgaaagccgtggtaaaccgattctgggcgatcgttttgcagaaagcggtctgctgtttaatctgagccatagccagaatctggcactgtgtgcagtgaattatacccgtcagattggtatcgatctggaatatctgcgtccgaccagtgatctggaaagcctggccaaacgtttttttctgcctcgtgaatatgaactgctgcgtagcctgccggatgaacagaaacagaaaatcttttttcgttattggacctgcaaagaagcctatctgaaagcaaccggtgatggtattgcaaaactggaagaaattgaaattgcactgaccccgaccgaaccggcaaaactgcaaaccgcaccggcatggtcactgctggaactggttccggatgataattgtgttgcagccgttgcagttgcaggttttggttggcagccgaaattttggcattattaa

SEQ ID NO: 94 - protein, 237 aa, Nostoc sp. PCC7120
MLQHTWLPKPPNLTLLSDEVHLWRIPLDQPESQLQDLAATLSSDELARANRFYFPEHRRRFTAGRGILRSILGGYLGVEPGQVKFDYESRGKPILGDRFAESGLLFNLSHSQNLALCAVNYTRQIGIDLEYLRPTSDLESLAKRFFLPREYELLRSLPDEQKQKIFFRYWTCKEAYLKATGDGIAKLEEIEIALTPTEPAKLQTAPAWSLLELVPDDNCVAAVAVAGFGWQPKFWHY

SEQ ID NO: 95 - DNA, 7959 bp, Moritella marina MP-1
  CDS (1)..(7959)
atggctaaaaagaacaccacatcgattaagcacgccaaggatgtgttaagtagtgatgatcaacagttaaattctcgcttgcaagaatgtccgattgccatcattggtatggcatcggtttttgcagatgctaaaaacttggatcaattctgggataacatcgttgactctgtggacgctattattgatgtgcctagcgatcgctggaacattgacgaccattactcggctgataaaaaagcagctgacaagacatactgcaaacgcggtggtttcattccagagcttgattttgatccgatggagtttggtttaccgccaaatatcctcgagttaactgacatcgctcaattgttgtcattaattgttgctcgtgatgtattaagtgatgctggcattggtagtgattatgaccatgataaaattggtatcacgctgggtgtcggtggtggtcagaaacaaatttcgccattaacgtcgcgcctacaaggcccggtattagaaaaagtattaaaagcctcaggcattgatgaagatgatcgcgctatgatcatcgacaaatttaaaaaagcctacatcggctgggaagagaactcattcccaggcatgctaggtaacgttattgctggtcgtatcgccaatcgttttgattttggtggtactaactgtgtggttgatgcggcatgcgctggctcccttgcagctgttaaaatggcgatctcagacttacttgaatatcgttcagaagtcatgatatcgggtggtgtatgttgtgataactcgccattcatgtatatgtcattctcgaaaacaccagcatttaccaccaatgatgatatccgtccgtttgatgacgattcaaaaggcatgctggttggtgaaggtattggcatgatggcgtttaaacgtcttgaagatgctgaacgtgacggcgacaaaatttattctgtactgaaaggtatcggtacatcttcagatggtcgtttcaaatctatttacgctccacgcccagatggccaagcaaaagcgctaaaacgtgcttatgaagatgccggttttgcccctgaaacatgtggtctaattgaaggccatggtacgggtaccaaagcgggtgatgccgcagaatttgctggcttgaccaaacactttggcgccgccagtgatgaaaagcaatatatcgccttaggctcagttaaatcgcaaattggtcatactaaatctgcggctggctctgcgggtatgattaaggcggcattagcgctgcatcataaaatcttacctgcaacgatccatatcgataaaccaagtgaagccttggatatcaaaaacagcccgttatacctaaacagcgaaacgcgtccttggatgccacgtgaagatggtattccacgtcgtgcaggtatcagctcatttggttttggcggcaccaacttccatattattttagaagagtatcgcccaggtcacgatagcgcatatcgcttaaactcagtgagccaaactgtgttgatctcggcaaacgaccaacaaggtattgttgctgagttaaataactggcgtactaaactggctgtcgatgctgatcatcaagggtttgtatttaatgagttagtgacaacgtggccattaaaaaccccatccgttaaccaagctcgtttaggttttgttgcgcgtaatgcaaatgaagcgatcgcgatgattgatacggcattgaaacaattcaatgcgaacgcagataaaatgacatggtcagtacctaccggggtttactatcgtcaagccggtattgatgcaacaggtaaagtggttgcgctattctcagggcaaggttcgcaatacgtgaacatgggtcgtgaattaacctgtaacttcccaagcatgatgcacagtgctgcggcgatggataaagagttcagtgccgctggtttaggccagttatctgcagttactttccctatccctgtttatacggatgccgagcgtaagctacaagaagagcaattacgtttaacgcaacatgcgcaaccagcgattggtagtttgagtgttggtctgttcaaaacgtttaagcaagcaggttttaaagctgattttgctgccggtcatagtttcggtgagttaaccgcattatgggctgccgatgtattgagcgaaagcgattacatgatgttagcgcgtagtcgtggtcaagcaatggctgcgccagagcaacaagattttgatgcaggtaagatggccgctgttgttggtgatccaaagcaagtcgctgtgatcattgatacccttgatgatgtctctattgctaacttcaactcgaataaccaagttgttattgctggtactacggagcaggttgctgtagcggttacaaccttaggtaatgctggtttcaaagttgtgccactgccggtatctgctgcgttccatacacctttagttcgtcacgcgcaaaaaccatttgctaaagcggttgatagcgctaaatttaaagcgccaagcattccagtgtttgctaatggcacaggcttggtgcattcaagcaaaccgaatgacattaagaaaaacctgaaaaaccacatgctggaatctgttcatttcaatcaagaaattgacaacatctatgctgatggtggccgcgtatttatcgaatttggtccaaagaatgtattaactaaattggttgaaaacattctcactgaaaaatctgatgtgactgctatcgcggttaatgctaatcctaaacaacctgcggacgtacaaatgcgccaagctgcgctgcaaatggcagtgcttggtgtcgcattagacaatattgacccgtacgacgccgttaagcgtccacttgttgcgccgaaagcatcaccaatgttgatgaagttatctgcagcgtcttatgttagtccgaaaacgaagaaagcgtttgctgatgcattgactgatggctggactgttaagcaagcgaaagctgtacctgctgttgtgtcacaaccacaagtgattgaaaagatcgttgaagttgaaaagatagttgaacgcattgtcgaagtagagcgtattgtcgaagtagaaaaaatcgtctacgttaatgctgacggttcgcttatatcgcaaaataatcaagacgttaacagcgctgttgttagcaacgtgactaatagctcagtgactcatagcagtgatgctgaccttgttgcctctattgaacgcagtgttggtcaatttgttgcacaccaacagcaattattaaatgtacatgaacagtttatgcaaggtccacaagactacgcgaaaacagtgcagaacgtacttgctgcgcagacgagcaatgaattaccggaaagtttagaccgtacattgtctatgtataacgagttccaatcagaaacgctacgtgtacatgaaacgtacctgaacaatcagacgagcaacatgaacaccatgcttactggtgctgaagctgatgtgctagcaaccccaataactcaggtagtgaatacagccgttgccactagtcacaaggtagttgctccagttattgctaatacagtgacgaatgttgtatctagtgtcagtaataacgcggcggttgcagtgcaaactgtggcattagcgcctacgcaagaaatcgctccaacagtcgctactacgccagcacccgcattggttgctatcgtggctgaacctgtgattgttgcgcatgttgctacagaagttgcaccaattacaccatcagttacaccagttgtcgcaactcaagcggctatcgatgtagcaactattaacaaagtaatgttagaagttgttgctgataaaaccggttatccaacggatatgctggaactgagcatggacatggaagctgacttaggtatcgactcaatcaaacgtgttgagatattaggcgcagtacaggaattgatccctgacttacctgaacttaatcctgaagatcttgctgagctacgcacgcttggtgagattgtcgattacatgaattcaaaagcccaggctgtagctcctacaacagtacctgtaacaagtgcacctgtttcgcctgcatctgctggtattgatttagcccacatccaaaacgtaatgttagaagtggttgcagacaaaaccggttacccaacagacatgctagaactgagcatggatatggaagctgacttaggtattgattcaatcaagcgtgtggaaatcttaggtgcagtacaggagatcataactgatttacctgagctaaaccctgaagatcttgctgaattacgcaccctaggtgaaatcgttagttacatgcaaagcaaagcgccagtcgctgaaagtgcgccagtggcgacggctcctgtagcaacaagctcagcaccgtctatcgatttgaaccacattcaaacagtgatgatggatgtagttgcagataagactggttatccaactgacatgctagaacttggcatggacatggaagctgatttaggtatcgattcaatcaaacgtgtggaaatattaggcgcagtgcaggagatcatcactgatttacctgagctaaacccagaagacctcgctgaattacgcacgctaggtgaaatcgttagttacatgcaaagcaaagcgccagtcgctgagagtgcgccagtagcgacggcttctgtagcaacaagctctgcaccgtctatcgatttaaaccatatccaaacagtgatgatggaagtggttgcagacaaaaccggttatccagtagacatgttagaacttgctatggacatggaagctgacctaggtatcgattcaatcaagcgtgtagaaattttaggtgcggtacaggaaatcattactgacttacctgagcttaaccctgaagatcttgctgaactacgtacattaggtgaaatcgttagttacatgcaaagcaaagcgcccgtagctgaagcgcctgcagtacctgttgcagtagaaagtgcacctactagtgtaacaagctcagcaccgtctatcgatttagaccacatccaaaatgtaatgatggatgttgttgctgataagactggttatcctgccaatatgcttgaattagcaatggacatggaagccgaccttggtattgattcaatcaagcgtgttgaaattctaggcgcggtacaggagatcattactgatttacctgaactaaacccagaagacttagctgaactacgtacgttagaagaaattgtaacctacatgcaaagcaaggcgagtggtgttactgtaaatgtagtggctagccctgaaaataatgctgtatcagatgcatttatgcaaagcaatgtggcgactatcacagcggccgcagaacataaggcggaatttaaaccggcgccgagcgcaaccgttgctatctctcgtctaagctctatcagtaaaataagccaagattgtaaaggtgctaacgccttaatcgtagctgatggcactgataatgctgtgttacttgcagaccacctattgcaaactggctggaatgtaactgcattgcaaccaacttgggtagctgtaacaacgacgaaagcatttaataagtcagtgaacctggtgactttaaatggcgttgatgaaactgaaatcaacaacattattactgctaacgcacaattggatgcagttatctatctgcacgcaagtagcgaaattaatgctatcgaatacccacaagcatctaagcaaggcctgatgttagccttcttattagcgaaattgagtaaagtaactcaagccgctaaagtgcgtggcgcctttatgattgttactcagcagggtggttcattaggttttgatgatatcgattctgctacaagtcatgatgtgaaaacagacctagtacaaagcggcttaaacggtttagttaagacactgtctcacgagtgggataacgtattctgtcgtgcggttgatattgcttcgtcattaacggctgaacaagttgcaagccttgttagtgatgaactacttgatgctaacactgtattaacagaagtgggttatcaacaagctggtaaaggccttgaacgtatcacgttaactggtgtggctactgacagctatgcattaacagctggcaataacatcgatgctaactcggtatttttagtgagtggtggcgcaaaaggtgtaactgcacattgtgttgctcgtatagctaaagaatatcagtctaagttcatcttattgggacgttcaacgttctcaagtgacgaaccgagctgggcaagtggtattactgatgaagcggcgttaaagaaagcagcgatgcagtctttgattacagcaggtgataaaccaacacccgttaagatcgtacagctaatcaaaccaatccaagctaatcgtgaaattgcgcaaaccttgtctgcaattaccgctgctggtggccaagctgaatatgtttctgcagatgtaactaatgcagcaagcgtacaaatggcagtcgctccagctatcgctaagttcggtgcaatcactggcatcattcatggcgcgggtgtgttagctgaccaattcattgagcaaaaaacactgagtgattttgagtctgtttacagcactaaaattgacggtttgttatcgctactatcagtcactgaagcaagcaacatcaagcaattggtattgttctcgtcagcggctggtttctacggtaaccccggccagtctgattactcgattgccaatgagatcttaaataaaaccgcataccgctttaaatcattgcacccacaagctcaagtattgagctttaactggggtccttgggacggtggcatggtaacgcctgagcttaaacgtatgtttgaccaacgtggtgtttacattattccacttgatgcaggtgcacagttattgctgaatgaactagccgctaatgataaccgttgtccacaaatcctcgtgggtaatgacttatctaaagatgctagctctgatcaaaagtctgatgaaaagagtactgctgtaaaaaagccacaagttagtcgtttatcagatgctttagtaactaaaagtatcaaagcgactaacagtagctctttatcaaacaagactagtgctttatcagacagtagtgcttttcaggttaacgaaaaccactttttagctgaccacatgatcaaaggcaatcaggtattaccaacggtatgcgcgattgcttggatgagtgatgcagcaaaagcgacttatagtaaccgagactgtgcattgaagtatgtcggtttcgaagactataaattgtttaaaggtgtggtttttgatggcaatgaggcggcggattaccaaatccaattgtcgcctgtgacaagggcgtcagaacaggattctgaagtccgtattgccgcaaagatctttagcctgaaaagtgacggtaaacctgtgtttcattatgcagcgacaatattgttagcaactcagccacttaatgctgtgaaggtagaacttccgacattgacagaaagtgttgatagcaacaataaagtaactgatgaagcacaagcgttatacagcaatggcaccttgttccacggtgaaagtctgcagggcattaagcagatattaagttgtgacgacaagggcctgctattggcttgtcagataaccgatgttgcaacagctaagcagggatccttcccgttagctgacaacaatatctttgccaatgatttggtttatcaggctatgttggtctgggtgcgcaaacaatttggtttaggtagcttaccttcggtgacaacggcttggactgtgtatcgtgaagtggttgtagatgaagtattttatctgcaacttaatgttgttgagcatgatctattgggttcacgcggcagtaaagcccgttgtgatattcaattgattgctgctgatatgcaattacttgccgaagtgaaatcagcgcaagtcagtgtcagtgacattttgaacgatatgtcatga

SEQ ID NO: 96 - protein, 2652 aa, Moritella marina MP-1
MAKKNTTSIKHAKDVLSSDDQQLNSRLQECPIAIIGMASVFADAKNLDQFWDNIVDSVDAIIDVPSDRWNIDDHYSADKKAADKTYCKRGGFIPELDFDPMEFGLPPNILELTDIAQLLSLIVARDVLSDAGIGSDYDHDKIGITLGVGGGQKQISPLTSRLQGPVLEKVLKASGIDEDDRAMIIDKFKKAYIGWEENSFPGMLGNVIAGRIANRFDFGGTNCVVDAACAGSLAAVKMAISDLLEYRSEVMISGGVCCDNSPFMYMSFSKTPAFTTNDDIRPFDDDSKGMLVGEGIGMMAFKRLEDAERDGDKIYSVLKGIGTSSDGRFKSIYAPRPDGQAKALKRAYEDAGFAPETCGLIEGHGTGTKAGDAAEFAGLTKHFGAASDEKQYIALGSVKSQIGHTKSAAGSAGMIKAALALHHKILPATIHIDKPSEALDIKNSPLYLNSETRPWMPREDGIPRRAGISSFGFGGTNFHIILEEYRPGHDSAYRLNSVSQTVLISANDQQGIVAELNNWRTKLAVDADHQGFVFNELVTTWPLKTPSVNQARLGFVARNANEAIAMIDTALKQFNANADKMTWSVPTGVYYRQAGIDATGKVVALFSGQGSQYVNMGRELTCNFPSMMHSAAAMDKEFSAAGLGQLSAVTFPIPVYTDAERKLQEEQLRLTQHAQPAIGSLSVGLFKTFKQAGFKADFAAGHSFGELTALWAADVLSESDYMMLARSRGQAMAAPEQQDFDAGKMAAVVGDPKQVAVIIDTLDDVSIANFNSNNQVVIAGTTEQVAVAVTTLGNAGFKVVPLPVSAAFHTPLVRHAQKPFAKAVDSAKFKAPSIPVFANGTGLVHSSKPNDIKKNLKNHMLESVHFNQEIDNIYADGGRVFIEFGPKNVLTKLVENILTEKSDVTAIAVNANPKQPADVQMRQAALQMAVLGVALDNIDPYDAVKRPLVAPKASPMLMKLSAASYVSPKTKKAFADALTDGWTVKQAKAVPAVVSQPQVIEKIVEVEKIVERIVEVERIVEVEKIVYVNADGSLISQNNQDVNSAVVSNVTNSSVTHSSDADLVASIERSVGQFVAHQQQLLNVHEQFMQGPQDYAKTVQNVLAAQTSNELPESLDRTLSMYNEFQSETLRVHETYLNNQTSNMNTMLTGAEADVLATPITQVVNTAVATSHKVVAPVIANTVTNVVSSVSNNAAVAVQTVALAPTQEIAPTVATTPAPALVAIVAEPVIVAHVATEVAPITPSVTPVVATQAAIDVATINKVMLEVVADKTGYPTDMLELSMDMEADLGIDSIKRVEILGAVQELIPDLPELNPEDLAELRTLGEIVDYMNSKAQAVAPTTVPVTSAPVSPASAGIDLAHIQNVMLEVVADKTGYPTDMLELSMDMEADLGIDSIKRVEILGAVQEIITDLPELNPEDLAELRTLGEIVSYMQSKAPVAESAPVATAPVATSSAPSIDLNHIQTVMMDVVADKTGYPTDMLELGMDMEADLGIDSIKRVEILGAVQEIITDLPELNPEDLAELRTLGEIVSYMQSKAPVAESAPVATASVATSSAPSIDLNHIQTVMMEVVADKTGYPVDMLELAMDMEADLGIDSIKRVEILGAVQEIITDLPELNPEDLAELRTLGEIVSYMQSKAPVAEAPAVPVAVESAPTSVTSSAPSIDLDHIQNVMMDVVADKTGYPANMLELAMDMEADLGIDSIKRVEILGAVQEIITDLPELNPEDLAELRTLEEIVTYMQSKASGVTVNVVASPENNAVSDAFMQSNVATITAAAEHKAEFKPAPSATVAISRLSSISKISQDCKGANALIVADGTDNAVLLADHLLQTGWNVTALQPTWVAVTTTKAFNKSVNLVTLNGVDETEINNIITANAQLDAVIYLHASSEINAIEYPQASKQGLMLAFLLAKLSKVTQAAKVRGAFMIVTQQGGSLGFDDIDSATSHDVKTDLVQSGLNGLVKTLSHEWDNVFCRAVDIASSLTAEQVASLVSDELLDANTVLTEVGYQQAGKGLERITLTGVATDSYALTAGNNIDANSVFLVSGGAKGVTAHCVARIAKEYQSKFILLGRSTFSSDEPSWASGITDEAALKKAAMQSLITAGDKPTPVKIVQLIKPIQANREIAQTLSAITAAGGQAEYVSADVTNAASVQMAVAPAIAKFGAITGIIHGAGVLADQFIEQKTLSDFESVYSTKIDGLLSLLSVTEASNIKQLVLFSSAAGFYGNPGQSDYSIANEILNKTAYRFKSLHPQAQVLSFNWGPWDGGMVTPELKRMFDQRGVYIIPLDAGAQLLLNELAANDNRCPQILVGNDLSKDASSDQKSDEKSTAVKKPQVSRLSDALVTKSIKATNSSSLSNKTSALSDSSAFQVNENHFLADHMIKGNQVLPTVCAIAWMSDAAKATYSNRDCALKYVGFEDYKLFKGVVFDGNEAADYQIQLSPVTRASEQDSEVRIAAKIFSLKSDGKPVFHYAATILLATQPLNAVKVELPTLTESVDSNNKVTDEAQALYSNGTLFHGESLQGIKQILSCDDKGLLLACQITDVATAKQGSFPLADNNIFANDLVYQAMLVWVRKQFGLGSLPSVTTAWTVYREVVVDEVFYLQLNVVEHDLLGSRGSKARCDIQLIAADMQLLAEVKSAQVSVSDILNDMS

SEQ ID NO: 97 - DNA, 2652 bp, Moritella marina MP-1
  CDS (1)..(2652)
atgacggaattagctgttattggtatggatgctaaatttagcggacaagacaatattgaccgtgtggaacgcgctttctatgaaggtgcttatgtaggtaatgttagccgcgttagtaccgaatctaatgttattagcaatggcgaagaacaagttattactgccatgacagttcttaactctgtcagtctactagcgcaaacgaatcagttaaatatagctgatatcgcggtgttgctgattgctgatgtaaaaagtgctgatgatcagcttgtagtccaaattgcatcagcaattgaaaaacagtgtgcgagttgtgttgttattgctgatttaggccaagcattaaatcaagtagctgatttagttaataaccaagactgtcctgtggctgtaattggcatgaataactcggttaatttatctcgtcatgatcttgaatctgtaactgcaacaatcagctttgatgaaaccttcaatggttataacaatgtagctgggttcgcgagtttacttatcgcttcaactgcgtttgccaatgctaagcaatgttatatatacgccaacattaagggcttcgctcaatcgggcgtaaatgctcaatttaacgttggaaacattagcgatactgcaaagaccgcattgcagcaagctagcataactgcagagcaggttggtttgttagaagtgtcagcagtcgctgattcggcaatcgcattgtctgaaagccaaggtttaatgtctgcttatcatcatacgcaaactttgcatactgcattaagcagtgcccgtagtgtgactggtgaaggcgggtgtttttcacaggtcgcaggtttattgaaatgtgtaattggtttacatcaacgttatattccggcgattaaagattggcaacaaccgagtgacaatcaaatgtcacggtggcggaattcaccattctatatgcctgtagatgctcgaccttggttcccacatgctgatggctctgcacacattgccgcttatagttgtgtgactgctgacagctattgtcatattcttttacaagaaaacgtcttacaagaacttgttttgaaagaaacagtcttgcaagataatgacttaactgaaagcaagcttcagactcttgaacaaaacaatccagtagctgatctgcgcactaatggttactttgcatcgagcgagttagcattaatcatagtacaaggtaatgacgaagcacaattacgctgtgaattagaaactattacagggcagttaagtactactggcataagtactatcagtattaaacagatcgcagcagactgttatgcccgtaatgatactaacaaagcctatagcgcagtgcttattgccgagactgctgaagagttaagcaaagaaataaccttggcgtttgctggtatcgctagcgtgtttaatgaagatgctaaagaatggaaaaccccgaagggcagttattttaccgcgcagcctgcaaataaacaggctgctaacagcacacagaatggtgtcaccttcatgtacccaggtattggtgctacttatgttggtttagggcgtgatctatttcatctattcccacagatttatcagcctgtagcggctttagccgatgacattggcgaaagtctaaaagatactttacttaatccacgcagtattagtcgtcatagctttaaagaactcaagcagttggatctggacctgcgcggtaacttagccaatatcgctgaagccggtgtgggttttgcttgtgtgtttaccaaggtatttgaagaagtctttgccgttaaagctgactttgctacaggttatagcatgggtgaagtaagcatgtatgcagcactaggctgctggcagcaaccgggattgatgagtgctcgccttgcacaatcgaatacctttaatcatcaactttgcggcgagttaagaacactacgtcagcattggggcatggatgatgtagctaacggtacgttcgagcagatctgggaaacctataccattaaggcaacgattgaacaggtcgaaattgcctctgcagatgaagatcgtgtgtattgcaccattatcaatacacctgatagcttgttgttagccggttatccagaagcctgtcagcgagtcattaagaatttaggtgtgcgtgcaatggcattgaatatggcgaacgcaattcacagcgcgccagcttatgccgaatacgatcacatggttgagctataccacatggatgttactccacgtattaataccaagatgtattcaagctcatgttatttaccgattccacaacgcagcaaagcgatttcccacagtattgctaaatgtttgtgtgatgtggtggatttcccacgtttggttaataccttacatgacaaaggtgcgcgggtattcattgaaatgggtccaggtcgttcgttatgtagctgggtagataagatcttagttaatggcgatggcgataataaaaagcaaagccaacatgtatctgttcctgtgaatgccaaaggcaccagtgatgaacttacttatattcgtgcgattgctaagttaattagtcatggcgtgaatttgaatttagatagcttgtttaacgggtcaatcctggttaaagcaggccatatagcaaacacgaacaaatag

SEQ ID NO: 98 - protein, 883 aa, Moritella marina MP-1
MTELAVIGMDAKFSGQDNIDRVERAFYEGAYVGNVSRVSTESNVISNGEEQVITAMTVLNSVSLLAQTNQLNIADIAVLLIADVKSADDQLVVQIASAIEKQCASCVVIADLGQALNQVADLVNNQDCPVAVIGMNNSVNLSRHDLESVTATISFDETFNGYNNVAGFASLLIASTAFANAKQCYIYANIKGFAQSGVNAQFNVGNISDTAKTALQQASITAEQVGLLEVSAVADSAIALSESQGLMSAYHHTQTLHTALSSARSVTGEGGCFSQVAGLLKCVIGLHQRYIPAIKDWQQPSDNQMSRWRNSPFYMPVDARPWFPHADGSAHIAAYSCVTADSYCHILLQENVLQELVLKETVLQDNDLTESKLQTLEQNNPVADLRTNGYFASSELALIIVQGNDEAQLRCELETITGQLSTTGISTISIKQIAADCYARNDTNKAYSAVLIAETAEELSKEITLAFAGIASVFNEDAKEWKTPKGSYFTAQPANKQAANSTQNGVTFMYPGIGATYVGLGRDLFHLFPQIYQPVAALADDIGESLKDTLLNPRSISRHSFKELKQLDLDLRGNLANIAEAGVGFACVFTKVFEEVFAVKADFATGYSMGEVSMYAALGCWQQPGLMSARLAQSNTFNHQLCGELRTLRQHWGMDDVANGTFEQIWETYTIKATIEQVEIASADEDRVYCTIINTPDSLLLAGYPEACQRVIKNLGVRAMALNMANAIHSAPAYAEYDHMVELYHMDVTPRINTKMYSSSCYLPIPQRSKAISHSIAKCLCDVVDFPRLVNTLHDKGARVFIEMGPGRSLCSWVDKILVNGDGDNKKQSQHVSVPVNAKGTSDELTYIRAIAKLISHGVNLNLDSLFNGSILVKAGHIANTNK

SEQ ID NO: 99 - DNA, 6036 bp, Moritella marina MP-1
  CDS (1)..(6036)
atggaaaatattgcagtagtaggtattgctaatttgttcccgggctcacaagcaccggatcaattttggcagcaattgcttgaacaacaagattgccgcagtaaggcgaccgctgttcaaatgggcgttgatcctgctaaatataccgccaacaaaggtgacacagataaattttactgtgtgcacggcggttacatcagtgatttcaattttgatgcttcaggttatcaactcgataatgattatttagccggtttagatgaccttaatcaatgggggctttatgttacgaaacaagcccttaccgatgcgggttattggggcagtactgcactagaaaactgtggtgtgattttaggtaatttgtcattcccaactaaatcatctaatcagctgtttatgcctttgtatcatcaagttgttgataatgccttaaaggcggtattacatcctgattttcaattaacgcattacacagcaccgaaaaaaacacatgctgacaatgcattagtagcaggttatccagctgcattgatcgcgcaagcggcgggtcttggtggttcacattttgcactggatgcggcttgtgcttcatcttgttatagcgttaagttagcgtgtgattacctgcatacgggtaaagccaacatgatgcttgctggtgcggtatctgcagcagatcctatgttcgtaaatatgggtttctcgatattccaagcttacccagctaacaatgtacatgccccgtttgaccaaaattcacaaggtctatttgccggtgaaggcgcgggcatgatggtattgaaacgtcaaagtgatgcagtacgtgatggtgatcatatttacgccattattaaaggcggcgcattatcgaatgacggtaaaggcgagtttgtattaagcccgaacaccaagggccaagtattagtatatgaacgtgcttatgccgatgcagatgttgacccgagtacagttgactatattgaatgtcatgcaacgggcacacctaagggtgacaatgttgaattgcgttcgatggaaacctttttcagtcgcgtaaataacaaaccattactgggctcggttaaatctaaccttggtcatttgttaactgccgctggtatgcctggcatgaccaaagctatgttagcgctaggtaaaggtcttattcctgcaacgattaacttaaagcaaccactgcaatctaaaaacggttactttactggcgagcaaatgccaacgacgactgtgtcttggccaacaactccgggtgccaaggcagataaaccgcgtaccgcaggtgtgagcgtatttggttttggtggcagcaacgcccatttggtattacaacagccaacgcaaacactcgagactaattttagtgttgctaaaccacgtgagcctttggctattattggtatggacagccattttggtagtgccagtaatttagcgcagttcaaaaccttattaaataataatcaaaataccttccgtgaattaccagaacaacgctggaaaggcatggaaagtaacgctaacgtcatgcagtcgttacaattacgcaaagcgcctaaaggcagttacgttgaacagctagatattgatttcttgcgttttaaagtaccgcctaatgaaaaagattgcttgatcccgcaacagttaatgatgatgcaagtggcagacaatgctgcgaaagacggaggtctagttgaaggtcgtaatgttgcggtattagtagcgatgggcatggaactggaattacatcagtatcgtggtcgcgttaatctaaccacccaaattgaagacagcttattacagcaaggtattaacctgactgttgagcaacgtgaagaactgaccaatattgctaaagacggtgttgcctcggctgcacagctaaatcagtatacgagtttcattggtaatattatggcgtcacgtatttcggcgttatgggatttttctggtcctgctattaccgtatcggctgaagaaaactctgtttatcgttgtgttgaattagctgaaaatctatttcaaaccagtgatgttgaagccgttattattgctgctgttgatttgtctggttcaattgaaaacattactttacgtcagcactacggtccagttaatgaaaagggatctgtaagtgaatgtggtccggttaatgaaagcagttcagtaaccaacaatattcttgatcagcaacaatggctggtgggtgaaggcgcagcggctattgtcgttaaaccgtcatcgcaagtcactgctgagcaagtttatgcgcgtattgatgcggtgagttttgcccctggtagcaatgcgaaagcaattacgattgcagcggataaagcattaacacttgctggtatcagtgctgctgatgtagctagtgttgaagcacatgcaagtggttttagtgccgaaaataatgctgaaaaaaccgcgttaccgactttatacccaagcgcaagtatcagttcggtgaaagccaatattggtcatacgtttaatgcctcgggtatggcgagtattattaaaacggcgctgctgttagatcagaatacgagtcaagatcagaaaagcaaacatattgctattaacggtctaggtcgtgataacagctgcgcgcatcttatcttatcgagttcagcgcaagcgcatcaagttgcaccagcgcctgtatctggtatggccaagcaacgcccacagttagttaaaaccatcaaactcggtggtcagttaattagcaacgcgattgttaacagtgcgagttcatctttacacgctattaaagcgcagtttgccggtaagcacttaaacaaagttaaccagccagtgatgatggataacctgaagccccaaggtattagcgctcatgcaaccaatgagtatgtggtgactggagctgctaacactcaagcttctaacattcaagcatctcatgttcaagcgtcaagtcatgcacaagagatagcaccaaaccaagttcaaaatatgcaagctacagcagccgctgtaagttcacccctttctcaacatcaacacacagcgcagcccgtagcggcaccgagcgttgttggagtgactgtgaaacataaagcaagtaaccaaattcatcagcaagcgtctacgcataaagcatttttagaaagtcgtttagctgcacagaaaaacctatcgcaacttgttgaattgcaaaccaagctgtcaatccaaactggtagtgacaatacatctaacaatactgcgtcaacaagcaatacagtgctaacaaatcctgtatcagcaacgccattaacacttgtgtctaatgcgcctgtagtagcgacaaacctaaccagtacagaagcaaaagcgcaagcagctgctacacaagctggttttcagataaaaggacctgttggttacaactatccaccgctgcagttaattgaacgttataataaaccagaaaacgtgatttacgatcaagctgatttggttgaattcgctgaaggtgatattggtaaggtatttggtgctgaatacaatattattgatggctattcgcgtcgtgtacgtctgccaacctcagattacttgttagtaacacgtgttactgaacttgatgccaaggtgcatgaatacaagaaatcatacatgtgtactgaatatgatgtgcctgttgatgcaccgttcttaattgatggtcagatcccttggtctgttgccgtcgaatcaggccagtgtgatttgatgttgatttcatatatcggtattgatttccaagcgaaaggcgaacgtgtttaccgtttacttgattgtgaattaactttccttgaagagatggcttttggtggcgatactttacgttacgagatccacattgattcgtatgcacgtaacggcgagcaattattattcttcttccattacgattgttacgtaggggataagaaggtacttatcatgcgtaatggttgtgctggtttctttactgacgaagaactttctgatggtaaaggcgttattcataacgacaaagacaaagctgagtttagcaatgctgttaaatcatcattcacgccgttattacaacataaccgtggtcaatacgattataacgacatgatgaagttggttaatggtgatgttgccagttgttttggtccgcaatatgatcaaggtggccgtaatccatcattgaaattctcgtctgagaagttcttgatgattgaacgtattaccaagatagacccaaccggtggtcattggggactaggcctgttagaaggtcagaaagatttagaccctgagcattggtatttcccttgtcactttaaaggtgatcaagtaatggctggttcgttgatgtcggaaggttgtggccaaatggcgatgttcttcatgctgtctcttggtatgcataccaatgtgaacaacgctcgtttccaaccactaccaggtgaatcacaaacggtacgttgtcgtgggcaagtactgccacagcgcaataccttaacttaccgtatggaagttactgcgatgggtatgcatccacagccattcatgaaagctaatattgatattttgcttgacggtaaagtggttgttgatttcaaaaacttgagcgtgatgatcagcgaacaagatgagcattcagattaccctgtaacactgccgagtaatgtggcgcttaaagcgattactgcacctgttgcgtcagtagcaccagcatcttcacccgctaacagcgcggatctagacgaacgtggtgttgaaccgtttaagtttcctgaacgtccgttaatgcgtgttgagtcagacttgtctgcaccgaaaagcaaaggtgtgacaccgattaagcattttgaagcgcctgctgttgctggtcatcatagagtgcctaaccaagcaccgtttacaccttggcatatgtttgagtttgcgacgggtaatatttctaactgtttcggtcctgattttgatgtttatgaaggtcgtattccacctcgtacaccttgtggcgatttacaagttgttactcaggttgtagaagtgcagggcgaacgtcttgatcttaaaaatccatcaagctgtgtagctgaatactatgtaccggaagacgcttggtactttactaaaaacagccatgaaaactggatgccttattcattaatcatggaaattgcattgcaaccaaatggctttatttctggttacatgggcacgacgcttaaataccctgaaaaagatctgttcttccgtaaccttgatggtagcggcacgttattaaagcagattgatttacgcggcaagaccattgtgaataaatcagtcttggttagtacggctattgctggtggcgcgattattcaaagtttcacgtttgatatgtctgtagatggcgagctattttatactggtaaagctgtatttggttactttagtggtgaatcactgactaaccaactgggcattgataacggtaaaacgactaatgcgtggtttgttgataacaatacccccgcagcgaatattgatgtgtttgatttaactaatcagtcattggctctgtataaagcgcctgtggataaaccgcattataaattggctggtggtcagatgaactttatcgatacagtgtcagtggttgaaggcggtggtaaagcgggcgtggcttatgtttatggcgaacgtacgattgatgctgatgattggttcttccgttatcacttccaccaagatccggtgatgccaggttcattaggtgttgaagctattattgagttgatgcagacctatgcgcttaaaaatgatttgggtggcaagtttgctaacccacgtttcattgcgccgatgacgcaagttgattggaaataccgtgggcaaattacgccgctgaataaacagatgtcactggacgtgcatatcactgagatcgtgaatgacgctggtgaagtgcgaatcgttggtgatgcgaatctgtctaaagatggtctgcgtatttatgaagttaaaaacatcgttttaagtattgttgaagcgtaa

SEQ ID NO: 100 - protein, 2011 aa, Moritella marina MP-1
MENIAVVGIANLFPGSQAPDQFWQQLLEQQDCRSKATAVQMGVDPAKYTANKGDTDKFYCVHGGYISDFNFDASGYQLDNDYLAGLDDLNQWGLYVTKQALTDAGYWGSTALENCGVILGNLSFPTKSSNQLFMPLYHQVVDNALKAVLHPDFQLTHYTAPKKTHADNALVAGYPAALIAQAAGLGGSHFALDAACASSCYSVKLACDYLHTGKANMMLAGAVSAADPMFVNMGFSIFQAYPANNVHAPFDQNSQGLFAGEGAGMMVLKRQSDAVRDGDHIYAIIKGGALSNDGKGEFVLSPNTKGQVLVYERAYADADVDPSTVDYIECHATGTPKGDNVELRSMETFFSRVNNKPLLGSVKSNLGHLLTAAGMPGMTKAMLALGKGLIPATINLKQPLQSKNGYFTGEQMPTTTVSWPTTPGAKADKPRTAGVSVFGFGGSNAHLVLQQPTQTLETNFSVAKPREPLAIIGMDSHFGSASNLAQFKTLLNNNQNTFRELPEQRWKGMESNANVMQSLQLRKAPKGSYVEQLDIDFLRFKVPPNEKDCLIPQQLMMMQVADNAAKDGGLVEGRNVAVLVAMGMELELHQYRGRVNLTTQIEDSLLQQGINLTVEQREELTNIAKDGVASAAQLNQYTSFIGNIMASRISALWDFSGPAITVSAEENSVYRCVELAENLFQTSDVEAVIIAAVDLSGSIENITLRQHYGPVNEKGSVSECGPVNESSSVTNNILDQQQWLVGEGAAAIVVKPSSQVTAEQVYARIDAVSFAPGSNAKAITIAADKALTLAGISAADVASVEAHASGFSAENNAEKTALPTLYPSASISSVKANIGHTFNASGMASIIKTALLLDQNTSQDQKSKHIAINGLGRDNSCAHLILSSSAQAHQVAPAPVSGMAKQRPQLVKTIKLGGQLISNAIVNSASSSLHAIKAQFAGKHLNKVNQPVMMDNLKPQGISAHATNEYVVTGAANTQASNIQASHVQASSHAQEIAPNQVQNMQATAAAVSSPLSQHQHTAQPVAAPSVVGVTVKHKASNQIHQQASTHKAFLESRLAAQKNLSQLVELQTKLSIQTGSDNTSNNTASTSNTVLTNPVSATPLTLVSNAPVVATNLTSTEAKAQAAATQAGFQIKGPVGYNYPPLQLIERYNKPENVIYDQADLVEFAEGDIGKVFGAEYNIIDGYSRRVRLPTSDYLLVTRVTELDAKVHEYKKSYMCTEYDVPVDAPFLIDGQIPWSVAVESGQCDLMLISYIGIDFQAKGERVYRLLDCELTFLEEMAFGGDTLRYEIHIDSYARNGEQLLFFFHYDCYVGDKKVLIMRNGCAGFFTDEELSDGKGVIHNDKDKAEFSNAVKSSFTPLLQHNRGQYDYNDMMKLVNGDVASCFGPQYDQGGRNPSLKFSSEKFLMIERITKIDPTGGHWGLGLLEGQKDLDPEHWYFPCHFKGDQVMAGSLMSEGCGQMAMFFMLSLGMHTNVNNARFQPLPGESQTVRCRGQVLPQRNTLTYRMEVTAMGMHPQPFMKANIDILLDGKVVVDFKNLSVMISEQDEHSDYPVTLPSNVALKAITAPVASVAPASSPANSADLDERGVEPFKFPERPLMRVESDLSAPKSKGVTPIKHFEAPAVAGHHRVPNQAPFTPWHMFEFATGNISNCFGPDFDVYEGRIPPRTPCGDLQVVTQVVEVQGERLDLKNPSSCVAEYYVPEDAWYFTKNSHENWMPYSLIMEIALQPNGFISGYMGTTLKYPEKDLFFRNLDGSGTLLKQIDLRGKTIVNKSVLVSTAIAGGAIIQSFTFDMSVDGELFYTGKAVFGYFSGESLTNQLGIDNGKTTNAWFVDNNTPAANIDVFDLTNQSLALYKAPVDKPHYKLAGGQMNFIDTVSVVEGGGKAGVAYVYGERTIDADDWFFRYHFHQDPVMPGSLGVEAIIELMQTYALKNDLGGKFANPRFIAPMTQVDWKYRGQITPLNKQMSLDVHITEIVNDAGEVRIVGDANLSKDGLRIYEVKNIVLSIVEA

SEQ ID NO: 101 - DNA, 1665 bp, Moritella marina MP-1
  CDS (1)..(1665)
atgaatatagtaagtaatcattcggcagctacaaaaaaggaattaagaatgtcgagtttaggttttaacaataacaacgcaattaactgggcttggaaagtagatccagcgtcagttcatacacaagatgcagaaattaaagcagctttaatggatctaactaaacctctctatgtggcgaataattcaggcgtaactggtatagctaatcatacgtcagtagcaggtgcgatcagcaataacatcgatgttgatgtattggcgtttgcgcaaaagttaaacccagaagatctgggtgatgatgcttacaagaaacagcacggcgttaaatatgcttatcatggcggtgcgatggcaaatggtattgcctcggttgaattggttgttgcgttaggtaaagcagggctgttatgttcatttggtgctgcaggtctagtgcctgatgcggttgaagatgcaattcgtcgtattcaagctgaattaccaaatggcccttatgcggttaacttgatccatgcaccagcagaagaagcattagagcgtggcgcggttgaacgtttcctaaaacttggcgtcaagacggtagaggcttcagcttaccttggtttaactgaacacattgtttggtatcgtgctgctggtctaactaaaaacgcagatggcagtgttaatatcggtaacaaggttatcgctaaagtatcgcgtaccgaagttggtcgccgctttatggaacctgcaccgcaaaaattactggataagttattagaacaaaataagatcacccctgaacaagctgctttagcgttgcttgtacctatggctgatgatattactggggaagcggattctggtggtcatacagataaccgtccgtttttaacattattaccgacgattattggtctgcgtgatgaagtgcaagcgaagtataacttctctcctgcattacgtgttggtgctggtggtggtatcggaacgcctgaagcagcactcgctgcatttaacatgggcgcggcttatatcgttctgggttctgtgaatcaggcgtgtgttgaagcgggtgcatctgaatatactcgtaaactgttatcgacagttgaaatggctgatgtgactatggcacctgctgcagatatgtttgaaatgggtgtgaagctgcaagtattaaaacgcggttctatgttcgcgatgcgtgcgaagaaactgtatgacttgtatgtggcttatgactcgattgaagatatcccagctgctgaacgtgagaagattgaaaaacaaatcttccgtgcaaacctagacgagatttgggatggcactatcgctttctttactgaacgcgatccagaaatgctagcccgtgcaacgagtagtcctaaacgtaaaatggcacttatcttccgttggtatcttggcctttcttcacgctggtcaaacacaggcgagaagggacgtgaaatggattatcagatttgggcaggcccaagtttaggtgcattcaacagctgggtgaaaggttcttaccttgaagactatacccgccgtggcgctgtagatgttgctttgcacatgcttaaagttgctgcgtatttacaacgtgtaaaccagttgaaattgcaaggtgttagcttaagtacagaattggcaagttatcgtacgagtgattaa

SEQ ID NO: 102 - protein, 554 aa, Moritella marina MP-1
MNIVSNHSAATKKELRMSSLGFNNNNAINWAWKVDPASVHTQDAEIKAALMDLTKPLYVANNSGVTGIANHTSVAGAISNNIDVDVLAFAQKLNPEDLGDDAYKKQHGVKYAYHGGAMANGIASVELVVALGKAGLLCSFGAAGLVPDAVEDAIRRIQAELPNGPYAVNLIHAPAEEALERGAVERFLKLGVKTVEASAYLGLTEHIVWYRAAGLTKNADGSVNIGNKVIAKVSRTEVGRRFMEPAPQKLLDKLLEQNKITPEQAALALLVPMADDITGEADSGGHTDNRPFLTLLPTIIGLRDEVQAKYNFSPALRVGAGGGIGTPEAALAAFNMGAAYIVLGSVNQACVEAGASEYTRKLLSTVEMADVTMAPAADMFEMGVKLQVLKRGSMFAMRAKKLYDLYVAYDSIEDIPAAEREKIEKQIFRANLDEIWDGTIAFFTERDPEMLARATSSPKRKMALIFRWYLGLSSRWSNTGEKGREMDYQIWAGPSLGAFNSWVKGSYLEDYTRRGAVDVALHMLKVAAYLQRVNQLKLQGVSLSTELASYRTSD

SEQ ID NO: 103 - DNA, 864 bp, Moritella marina MP-1
  CDS (1)..(864)
atgtacagcggcgtaaaagataagctcaccctcactacaaatgaaatccatttatggtcggttactccgcaaactatccaacagcctgaattattacaggcttatagccaactgttatcacctgcagaaacaataaaacaacaacgctttcgatttgaaaaagatcgtcacaatgctctcatcactcgtgctttcgtccgtgatttattatctcactatgcagatgttttaccggctgattggcagtttgtgaagggggaaaaggataaaccagagatagcgaatcccccactcccactgcgctttaatattagtcataccgataacttaatcatttgtgccgtcatgctcaatgatgatatcggttgtgatgtcgaaaatacactgcgtagcagtaatgtcttgagtattgctaaacattcattctcagatagtgaattcaatgatttacttactcaacccactgcacaacaaaccagtcgtttttttgattactggacgttaaaagaatcttatatcaaagcatggggcttgggtttatcgatcccgttgaaagatttcagcttcacgctacccgaaggctttcaacagcagtatcaacaagaagatcagcaagaaaaccagcattgtattgataccattaaattaagctttgcacctcaccgtattgataatcccaacatttggcgtcattggctgttctatccaaataatacccacagagttgcactggctgtgcgcgcgcgaagtaataatcagcagactgaatataaaatgcgattttttaattcgacaccactgattaatatcactgaaacacttatttttaaacctgagactaattttaaacctgacgctaaatag

SEQ ID NO: 104 - protein, 287 aa, Moritella marina MP-1
MYSGVKDKLTLTTNEIHLWSVTPQTIQQPELLQAYSQLLSPAETIKQQRFRFEKDRHNALITRAFVRDLLSHYADVLPADWQFVKGEKDKPEIANPPLPLRFNISHTDNLIICAVMLNDDIGCDVENTLRSSNVLSIAKHSFSDSEFNDLLTQPTAQQTSRFFDYWTLKESYIKAWGLGLSIPLKDFSFTLPEGFQQQYQQEDQQENQHCIDTIKLSFAPHRIDNPNIWRHWLFYPNNTHRVALAVRARSNNQQTEYKMRFFNSTPLINITETLIFKPETNFKPDAK

SEQ ID NO: 105 - DNA, 2445 bp, Escherichia coli
  CDS (1)..(2445)
atgatgattttgagtattctcgctacggttgtcctgctcggcgcgttgttctatcaccgcgtgagcttatttatcagcagtctgattttgctcgcctggacagccgccctcggcgttgctggtctgtggtcggcgtgggtactggtgcctctggccattatcctcgtgccatttaactttgcgcctatgcgtaagtcgatgatttccgcgccggtatttcgcggtttccgtaaggtgatgccgccgatgtcgcgcactgagaaagaagcgattaatgcgggcaccacctggtgggagggcgacttgttccagggcaagccggactggaaaaagctgcataactatccgcagccgcgcctgaccgccgaagagcaagcgtttctcgacggcccggtagaagaagcctgccggatggcgaatgatttccagattactcatgagctggcggatctgccgccggagttgtgggcgtaccttaaagagcatcgcttcttcgcgatgattatcaaaaaagagtacggcggactggagttctcagcttatgcccagtctcgcgtgctgcaaaaactctccggcgtgagcgggatcctggcgattaccgtcggcgtgccgaactcattaggcccgggcgaactgttgcaacattacggcactgacgagcagaaagatcactatctgccgcgtctggcgcgtggtcaggagatcccctgctttgcactgaccagcccggaagcgggttccgatgcgggcgcgattccggacaccgggattgtctgcatgggcgaatggcagggccagcaggtgctggggatgcgtctgacctggaacaaacgctacattacgctggcaccgattgcgaccgtgcttgggctggcgtttaaactctccgacccggaaaaattactcggcggtgcagaagatttaggcattacctgtgcgctgatcccaaccaccacgccgggcgtggaaattggtcgtcgccacttcccgctgaacgtaccgttccagaacggaccgacgcgcggtaaagatgtcttcgtgccgatcgattacatcatcggcgggccgaaaatggccgggcaaggctggcggatgctggtggagtgcctctcggtaggccgcggcatcaccctgccttccaactcaaccggcggcgtgaaatcggtagcgctggcaaccggcgcgtatgctcacattcgccgtcagttcaaaatctctattggtaagatggaagggattgaagagccgctggcgcgtattgccggtaatgcctacgtgatggatgctgcggcatcgctgattacctacggcattatgctcggcgaaaaacctgccgtgctgtcggctatcgttaagtatcactgtacccaccgcgggcagcagtcgattattgatgcgatggatattaccggcggtaaaggcattatgctcgggcaaagcaacttcctggcgcgtgcttaccagggcgcaccgattgccatcaccgttgaaggggctaacattctgacccgcagcatgatgatcttcggacaaggagcgattcgttgccatccgtacgtgctggaagagatggaagcggcgaagaacaatgacgtcaacgcgttcgataaactgttgttcaaacatatcggtcacgtcggtagcaacaaagttcgcagcttctggctgggcctgacgcgcggtttaaccagcagcacgccaaccggcgatgccactaaacgctactatcagcacctgaaccgcctgagcgccaacctcgccctgctttctgatgtctcgatggctgtgctgggcggcagcctgaaacgtcgcgagcgcatctcggcccgtctgggggatattttaagccagctctacctcgcctctgccgtgctgaagcgttatgacgacgaaggccgtaatgaagccgacctgccgctggtgcactggggcgtacaagatgcgctgtatcaggctgaacaggcgatggatgatttactgcaaaacttcccgaaccgcgtggttgccgggctgctgaatgtggtgatcttcccgaccggacgtcattatctggcaccttctgacaagctggatcataaagtggcgaagattttacaagtgccgaacgccacccgttcccgcattggtcgcggtcagtacctgacgccgagcgagcataatccggttggcttgctggaagaggcgctggtggatgtgattgccgccgacccaattcatcagcggatctgtaaagagctgggtaaaaacctgccgtttacccgtctggatgaactggcgcacaacgcgctggtgaaggggctgattgataaagatgaagccgctattctggtgaaagctgaagaaagccgtctgcgcagtattaacgttgatgactttgatccggaagagctggcgacgaagccggtaaagttgccggagaaagtgcggaaagttgaagccgcgtaa

SEQ ID NO: 106 - protein, 814 aa, Escherichia coli
MMILSILATVVLLGALFYHRVSLFISSLILLAWTAALGVAGLWSAWVLVPLAIILVPFNFAPMRKSMISAPVFRGFRKVMPPMSRTEKEAINAGTTWWEGDLFQGKPDWKKLHNYPQPRLTAEEQAFLDGPVEEACRMANDFQITHELADLPPELWAYLKEHRFFAMIIKKEYGGLEFSAYAQSRVLQKLSGVSGILAITVGVPNSLGPGELLQHYGTDEQKDHYLPRLARGQEIPCFALTSPEAGSDAGAIPDTGIVCMGEWQGQQVLGMRLTWNKRYITLAPIATVLGLAFKLSDPEKLLGGAEDLGITCALIPTTTPGVEIGRRHFPLNVPFQNGPTRGKDVFVPIDYIIGGPKMAGQGWRMLVECLSVGRGITLPSNSTGGVKSVALATGAYAHIRRQFKISIGKMEGIEEPLARIAGNAYVMDAAASLITYGIMLGEKPAVLSAIVKYHCTHRGQQSIIDAMDITGGKGIMLGQSNFLARAYQGAPIAITVEGANILTRSMMIFGQGAIRCHPYVLEEMEAAKNNDVNAFDKLLFKHIGHVGSNKVRSFWLGLTRGLTSSTPTGDATKRYYQHLNRLSANLALLSDVSMAVLGGSLKRRERISARLGDILSQLYLASAVLKRYDDEGRNEADLPLVHWGVQDALYQAEQAMDDLLQNFPNRVVAGLLNVVIFPTGRHYLAPSDKLDHKVAKILQVPNATRSRIGRGQYLTPSEHNPVGLLEEALVDVIAADPIHQRICKELGKNLPFTRLDELAHNALVKGLIDKDEAAILVKAEESRLRSINVDDFDPEELATKPVKLPEKVRKVEAA

SEQ ID NO: 107 - DNA, 31 bp, Artificial Sequence
  Synthetic DNA
gacagtgaaatgctgattaagaaattccaag

SEQ ID NO: 108 - DNA, 36 bp, Artificial Sequence
  Synthetic DNA
tttggatccctatgacagaagctccttctctggctc

SEQ ID NO: 109 - DNA, 36 bp, Artificial Sequence
  Synthetic DNA
tttggtcatatgggtgttaagcggagactcatgatg

SEQ ID NO: 110 - DNA, 24 bp, Artificial Sequence
  Synthetic DNA
cttgtgccactaggaagctgccag

SEQ ID NO: 111 - DNA, 42 bp, Artificial Sequence
  Synthetic DNA
ttcactcatatgacaacgcaaactatgaataatgaaaagctg

SEQ ID NO: 112 - DNA, 39 bp, Artificial Sequence
  Synthetic DNA
ttcggatccttaaatcattttctcaacaggcttccaacg

SEQ ID NO: 113 - DNA, 34 bp, Artificial Sequence
  Synthetic DNA
ttttcccatatgccattgcgcatcgctcttttag

SEQ ID NO: 114 - DNA, 37 bp, Artificial Sequence
  Synthetic DNA
tttggatcctcacactggctctccttgtgtagtgttc

SEQ ID NO: 115 - DNA, 51 bp, Artificial Sequence
  Synthetic DNA
gtttaactttaataaggagatataccatgccattgcgcatcgctcttttag

SEQ ID NO: 116 - DNA, 22 bp, Artificial Sequence
  Synthetic DNA
gcactccagtcgccttcccgtt

SEQ ID NO: 117 - DNA, 49 bp, Artificial Sequence
  Synthetic DNA
gcgcaatggcatggtatatctccttattaaagttaaacaaaattatttc

SEQ ID NO: 118 - DNA, 35 bp, Artificial Sequence
  Synthetic DNA
ttccttcatatgcattgcccagttaattacgcacc

SEQ ID NO: 119 - DNA, 21 bp, Artificial Sequence
  Synthetic DNA
ccgacttcaagctttgcatcg

SEQ ID NO: 120 - DNA, 20 bp, Artificial Sequence
  Synthetic DNA
cctgcgaacggttctgcggc

SEQ ID NO: 121 - DNA, 39 bp, Artificial Sequence
  Synthetic DNA
ttcggatcctcaggcttcttcaatacagattgcaatgtc

SEQ ID NO: 122 - DNA, 30 bp, Artificial Sequence
  Synthetic DNA
acggaattcatgagccataccccttcacag

SEQ ID NO: 123 - DNA, 27 bp, Artificial Sequence
  Synthetic DNA
acgctcgagtcacttaacacttacctc

SEQ ID NO: 124 - DNA, 22 bp, Artificial Sequence
  Synthetic DNA
gcactccagtcgccttcccgtt

SEQ ID NO: 125 - DNA, 59 bp, Artificial Sequence
  Synthetic DNA
ctgtgaaggggtatggctcatatgtatatctccttcttaaagttaaacaaaattatttc

SEQ ID NO: 126 - DNA, 19 bp, Artificial Sequence
  Synthetic DNA
gagccataccccttcacag

SEQ ID NO: 127 - DNA, 20 bp, Artificial Sequence
  Synthetic DNA
ggcaggtcgatggtttcctc

SEQ ID NO: 128 - DNA, 63 bp, Artificial Sequence
  Synthetic DNA
tatgaattctttaagaaggagatatacatatgaatttaaaccactcgcttcgcaaaactcctg

SEQ ID NO: 129 - DNA, 50 bp, Artificial Sequence
  Synthetic DNA
ttgggggatccttagcttaggattttttttttagtatccgctttttcttc

SEQ ID NO: 130 - DNA, 46 bp, Artificial Sequence
  Synthetic DNA
gagtcagcatatgatgcctcaaccagattacctagacttcaccctc

SEQ ID NO: 131 - DNA, 39 bp, Artificial Sequence
  Synthetic DNA
gacggatccgcaagcttgtcgagctaccaagttagttcc

SEQ ID NO: 132 - DNA, 49 bp, Artificial Sequence
  Synthetic DNA
aaactgcagcatatgaaaatagcaatcataggcttatctggtttgtttc

SEQ ID NO: 133 - DNA, 41 bp, Artificial Sequence
  Synthetic DNA
ataggatccttaagcttcttctatacctagagccaagtccg

SEQ ID NO: 134 - DNA, 47 bp, Artificial Sequence
  Synthetic DNA
tatctcgagctagctaattgctagagaaaaattagggactggattgg

SEQ ID NO: 135 - DNA, 47 bp, Artificial Sequence
  Synthetic DNA
tatggatccctagctaattgctagagaaaaattagggactggattgg

SEQ ID NO: 136 - DNA, 780 bp, Aureispira marina
cgaacattagaaccttctgagaatcctttcttacaacatcatgttattcaagggcaagccgttttgccagtggtaagtgctatgggctggatggcgactactgctgaacaaattttccctgattttagaacatttgaagtagccaatacaaagttattcaaagggctagtatttgatggtaatcaacctaaagctttcgtaactactttggtagaaaaagaaaaaaatgcttcgaccattgtactagaagcaaccattagcagccaagcacctaccgctaaattgcctacttttcactacaaagctacgcttacactaaaagccaaaaatttaggtttagaacaacctacctttgaagctactttaagcagtgattatacggctagttcaggtgcagttttgtatgagaatggcgccctttttcacgggaaacacttccaaggtattgaggagattttagattggaatgaacaccaaattgtcttaaaatgtaaagcacctcaagtttcaagagcagaacaaggccaattcccaatcttaggagtgaataccttctttgcagacattcaataccaagggatggttatttgggtacaaaaataccatgatggagccaaatctttgcctttagctacagaaagtgcgcaactctttgctcctgttccttttgacaaagaattattggttcatattgaaattgtagaagatactcctttcaaaatggtagccaactgcactacttatgatgctgatggaaaagtatatctatctactagaaat

SEQ ID NO: 137 - protein, 256 aa, Psychloflexus torquis
RHLSLKDNAFLKDHVIQGNSVLPMVNATAWMADSCVKLFPDYKLTSIAHVKLFKGIVFDGTEKEVYFTEIKEQSKTADHIVCDVTVYSKGVKLPLNHYRSTITLSRKRSDKPKFQTPTLKENKIDGATFYKDGSLFQGPFYQGIETVLSIDKDQVLLKCKAPAVSLETQGQFPSTSLNAFFLDIQYQGMILWVQKYHNGANSLPLQTIEGLVYGEIPANKSFYVHMKVQENSAIKMIADITVYDENRDVFLFTEGA

SEQ ID NO: 138 - protein, 825 aa, Psychloflexus torquis
MEIKETTSKQEFSLPTKFYNVPRKSIGLKFIPKVDLLVQDISALKPVVITDEGSDLTLAVKAKLESEGHTVIVIQFDAFKKNPNLKNGISISDINDQNIKTAIDTILAKNDIGSFIYLHPHFTFSGSNFTQHFDTERALLKATFLLAKQLQAPLNANSKTQRTAFMTVSRLDGKFGMDKRSNMSIIAGGLSGLTKCMNLEWSPVFCRAIDAKPELAATEIADALFLELHDADVRYVDVAITENGRMTYEVTTNEVSAAEDYQQTVTDKDVFLVAGGGRGVTATCIKEMNIAFKSKFILLGRSALDFELPAYALNGVGPAALKNEIMQEMKSGGEKVSIKGLNNRFNKYVAKKEIEETIAHIKANGGDAIYVAGDVTNLTIKPELLEIEKKWGKITGIIHGAGRLADKLIQDKTEQIFDDVTSVKLDGLTSLLKMVNVNELRHLIMFSSVAGFYGNVGQSDYAMANEILSTAAHLFSTNHPNTKVTSINWGAWEGGMVSPELQKMFEEAGVSLVNHPGGAARFVQELNGAYHHQSQVIIGGTLPASISDISGPLKNYTIQRHLSLKDNAFLKDHVIQGNSVLPMVNATAWMADSCVKLFPDYKLTSIAHVKLFKGIVFDGTEKEVYFTEIKEQSKTADHIVCDVTVYSKGVKLPLNHYRSTITLSRKRSDKPKFQTPTLKENKIDGATFYKDGSLFQGPFYQGIETVLSIDKDQVLLKCKAPAVSLETQGQFPSTSLNAFFLDIQYQGMILWVQKYHNGANSLPLQTIEGLVYGEIPANKSFYVHMKVQENSAIKMIADITVYDENRDVFLFTEGAGLTVSEGLTW

SEQ ID NO: 139 - DNA, 768 bp, Psychloflexus torquis
cggcatttaagtttaaaagacaatgcgtttttaaaggatcacgttattcaaggcaattctgttttaccaatggtaaacgccacagcgtggatggcagattcttgtgtaaaactattcccagattataaattaacgagtatagcacatgtaaaactgtttaaagggattgtttttgatggcactgaaaaagaagtttatttcacagaaattaaagaacaaagtaaaactgcagaccatattgtttgtgatgtcactgtgtatagtaaaggggtgaagctacctttaaatcattaccgttcaaccattacgctttcgcgaaaaagaagcgataaacctaaatttcaaacccctacactaaaagagaacaaaatagatggcgctaccttttataaagatggttctttatttcaaggtcctttttaccaagggatagaaacggttttatctatagataaagatcaagttttactaaaatgtaaagcaccagcagtttctttagaaacacaagggcagtttcctagcacgagtttaaacgcatttttcttagatatacaatatcaaggcatgattctatgggtgcaaaagtatcataacggtgctaatagtttgcctttacaaacaatagaaggactggtttatggggaaattcctgcaaataaaagtttctatgtacatatgaaagtacaagaaaattcagctataaaaatgatcgcagacataaccgtatatgatgaaaatagagatgtttttttattcacagaaggcgct

SEQ ID NO: 140 - DNA, 2475 bp, Psychloflexus torquis
atggaaatcaaggagactacctcaaaacaggaattctccttgcctaccaaattctacaatgtgccccggaaatctatcggcttaaaatttattcctaaagtagatcttttagtacaggacatttcggcattaaaacctgttgtaattacagacgaaggaagcgatttgactttggctgtaaaagcaaaattagaaagcgaaggccataccgttattgtcattcaatttgacgcttttaaaaagaatcctaatctaaaaaatgggatttctatttcagacataaatgaccaaaatataaaaacggctattgatacaatcttagctaaaaatgacattggttcttttatttatttacacccacatttcaccttttcaggatctaatttcacacaacattttgatacagagcgtgcattgctaaaagccactttcttattggcaaaacagctacaagcaccattaaatgccaacagcaaaacacaacgaactgcttttatgaccgtatctcgtttagacggaaaatttggaatggacaaacgttctaatatgtctatcattgctggtggattatctggattaacgaaatgtatgaatctagaatggtctccagtattttgcagagcaatcgatgcaaaacctgaattagcggcaacagaaattgcggatgctttattcttagaattacacgatgcagatgtacgctatgtcgatgtcgccatcactgaaaatggacggatgacttatgaggttacaacgaatgaagtaagtgctgcagaagactaccaacaaacggttacagataaagacgtttttttagttgctggcggtggtagaggtgttaccgcgacctgtatcaaagaaatgaacattgcttttaaatccaaatttatccttttagggagatctgctttagattttgaattaccagcttatgcgttaaatggagtcggccctgcagcccttaaaaatgagattatgcaggagatgaaatccggtggagaaaaagtttcaattaaagggctaaacaataggtttaataaatacgttgctaaaaaggaaattgaagaaactattgcgcacatcaaagcaaatggtggcgacgctatttatgtggcgggtgatgttacgaatttaaccatcaaacctgaattacttgagattgaaaaaaaatggggtaaaattactggaattattcacggtgctggtcgtttagcggataagctcattcaagataaaactgaacagatttttgatgatgtgacttccgtaaaattagatggtttaacaagcctcttaaaaatggtaaacgtgaacgaattaaggcatttaattatgttttcttcagtggcgggtttctacggaaatgttggccaatctgattatgcgatggccaacgaaattttaagtaccgcggcacatttgtttagtaccaaccatcctaacactaaagttacctcaattaattggggcgcttgggaaggcggtatggtaagtccggagttacaaaaaatgtttgaagaagcaggtgtttctttggtcaaccatccaggcggcgctgctcgttttgttcaagaattaaacggggcgtatcaccaccaatcccaagtcataattggaggcactttacctgcaagtatttcagatatttctggccctttaaaaaactatactattcaacggcatttaagtttaaaagacaatgcgtttttaaaggatcacgttattcaaggcaattctgttttaccaatggtaaacgccacagcgtggatggcagattcttgtgtaaaactattcccagattataaattaacgagtatagcacatgtaaaactgtttaaagggattgtttttgatggcactgaaaaagaagtttatttcacagaaattaaagaacaaagtaaaactgcagaccatattgtttgtgatgtcactgtgtatagtaaaggggtgaagctacctttaaatcattaccgttcaaccattacgctttcgcgaaaaagaagcgataaacctaaatttcaaacccctacactaaaagagaacaaaatagatggcgctaccttttataaagatggttctttatttcaaggtcctttttaccaagggatagaaacggttttatctatagataaagatcaagttttactaaaatgtaaagcaccagcagtttctttagaaacacaagggcagtttcctagcacgagtttaaacgcatttttcttagatatacaatatcaaggcatgattctatgggtgcaaaagtatcataacggtgctaatagtttgcctttacaaacaatagaaggactggtttatggggaaattcctgcaaataaaagtttctatgtacatatgaaagtacaagaaaattcagctataaaaatgatcgcagacataaccgtatatgatgaaaatagagatgtttttttattcacagaaggcgctggattaaccgtttcagaaggcttaacctgg

The invention claimed is:

1. A microorganism capable of producing a ω-6 polyunsaturated fatty acid (PUFA),
   in which the reactivity of a polyketide synthase dehydratase (PS-DH) domain with 3-hydroxyhexanoyl acyl carrier protein (3-hydroxyhexanoyl ACP) in the microorganism is higher than the reactivity of a FabA-like β-hydroxyacyl-ACP dehydratase (FabA-DH) domain with 3-hydroxyhexanoyl ACP in the microorganism, and
   wherein the microorganism has an anaerobic pathway involving a protein complex having PUFA-PKS activity,
   wherein proteins constituting the protein complex having PUFA-PKS activity are one of the following combinations (i) to (v):
   (i) PhoA, PhoB, PhoC, PhoD, EpaE, AraB,
   (ii) EpaA, PhoB, PhoC, PhoD, EpaE, AraB,
   (iii) EpaA, AraB, AraC, AraD, EpaE,
   (iv) PhoA, AraB, AraC, AraD, EpaE, and
   (v) OrfA, OrfB, OrfC, EpaE, AraB, and
   wherein
   the amino acid sequence of AraB is SEQ ID NO: 58,
   the amino acid sequence of AraC is SEQ ID NO: 60,
   the amino acid sequence of AraD is SEQ ID NO: 62,
   the amino acid sequence of PhoA is SEQ ID NO: 66,
   the amino acid sequence of PhoB is SEQ ID NO: 68,
   the amino acid sequence of PhoC is SEQ ID NO: 70,
   the amino acid sequence of PhoD is SEQ ID NO: 72,
   the amino acid sequence of EpaA is SEQ ID NO: 74,
   the amino acid sequence of EpaE is SEQ ID NO: 82,
   the amino acid sequence of OrfA is SEQ ID NO: 84,
   the amino acid sequence of OrfB is SEQ ID NO: 86 or 90, and
   the amino acid sequence of OrfC is SEQ ID NO: 88 or 92.

2. The microorganism according to claim 1, wherein the microorganism capable of producing a ω-6 PUFA is a microorganism having a ω-3 PUFA metabolic pathway.

3. The microorganism according to claim 1, wherein
   the microorganism capable of producing a ω-6 PUFA is a microorganism having an eicosapentaenoic acid (EPA) metabolic pathway or docosahexaenoic acid (DHA) metabolic pathway, and
   the ω-6 PUFA that can be produced is arachidonic acid (ARA) or docosapentaenoic acid (DPA).

4. The microorganism according to claim 1, wherein the microorganism capable of producing a ω-6 PUFA is derived from the genus *Shewanella*, the genus *Photobacterium*, the genus *Moritella*, the genus *Colwellia*, the genus *Aurantiochytrium*, the genus *Thraustochytrium*, the genus *Ulkenia*, the genus *Parietichytrium*, the genus *Labyrinthula*, the genus *Aplanochytrium*, the genus *Oblongichytrium*, or the genus *Schizochytrium*.

5. A microorganism capable of producing a ω-6 PUFA,
   in which genes encoding respective domains described in the following (a) to (j) having an activity of synthesizing a PUFA (hereinafter referred to as PUFA-PKS activity) have been introduced into a microorganism that does not have a PUFA metabolic pathway:
   (a) a β-ketoacyl-ACP synthase (hereinafter referred to as KS) domain;
   (b) a malonyl-CoA:ACP acyltransferase (hereinafter referred to as MAT) domain;
   (c) an acyl carrier protein (ACP) domain;
   (d) a ketoreductase (hereinafter referred to as KR) domain;
   (e) a PS-DH domain;
   (f) a chain elongation factor (hereinafter, referred to as CLF) domain;
   (g) an acyltransferase (hereinafter referred to as AT) domain;
   (h) a FabA-DH domain;
   (i) an enoyl-ACP reductase (hereinafter referred to as ER) domain; and
   (j) a phosphopantetheine transferase (hereinafter referred to as PPT) domain, and
   wherein
   the reactivity of a PS-DH domain with 3-hydroxyhexanoyl ACP in the microorganism is higher than the reactivity of a FabA-DH domain with 3-hydroxyhexanoyl ACP in the microorganism
   wherein the introduced genes are one of the following combinations:
   (i) phoA, phoB, phoC, phoD, epaE, araB,
   (ii) epaA, phoB, phoC, phoD, epaE, araB,
   (iii) epaA, araB, araC, araD, epaE,
   (iv) phoA, araB, araC, araD, epaE, and
   (v) orfA, orfB, orfC, epaE, araB, and
   wherein
   the amino acid sequence of the protein encoded by the arab gene is SEQ ID NO: 58,
   the amino acid sequence of the protein encoded by the araC gene is SEQ ID NO: 60,
   the amino acid sequence of the protein encoded by the araD gene is SEQ ID NO: 62,
   the amino acid sequence of the protein encoded by the phoA gene is SEQ ID NO: 66,
   the amino acid sequence of the protein encoded by the phoB gene is SEQ ID NO: 68,
   the amino acid sequence of the protein encoded by the phoC gene is SEQ ID NO: 70,
   the amino acid sequence of the protein encoded by the phoD gene is SEQ ID NO: 72,
   the amino acid sequence of the protein encoded by the epaA gene is SEQ ID NO: 74,
   the amino acid sequence of the protein encoded by the epaE gene is SEQ ID NO: 82,
   the amino acid sequence of the protein encoded by the orfA gene is SEQ ID NO: 84,
   the amino acid sequence of the protein encoded by the orfB gene is SEQ ID NO: 86 or 90, and
   the amino acid sequence of the protein encoded by the orfC gene is SEQ ID NO: 88 or 92.

6. The microorganism according to claim 5, which possesses all PUFA synthetic pathway genes possessed by the microorganism capable of producing a ω-6 PUFA, wherein the reactivity of the PS-DH domain with 3-hydroxyhexanoyl ACP in the microorganism is higher than the reactivity of a FabA-DH domain with 3-hydroxyhexanoyl ACP in the microorganism.

7. The microorganism according to claim 5, wherein the ω-6 PUFA produced is ARA or DPA.

8. The microorganism according to claim 5, wherein the microorganism that does not have a PUFA metabolic pathway is a microorganism belonging to the genus *Escherichia*, the genus *Bacillus*, the genus *Corynebacterium*, the genus *Yarrowia*, the genus *Saccharomyces*, the genus *Candida*, or the genus *Pichia*.

9. A method for producing a ω-6 PUFA or a ω-6 PUFA-containing composition, comprising:
   culturing the microorganism according to claim 1 in a culture medium so as to produce and accumulate a ω-6 PUFA or a ω-6 PUFA-containing composition in a culture, and collecting the ω-6 PUFA or the ω-6 PUFA-containing composition from the culture.

10. A method for producing a ω-6 PUFA or a ω-6 PUFA-containing composition using the following microorganism (I) or (II) capable of producing a ω-6 PUFA:
(I) a microorganism capable of producing a ω-6 PUFA, in which the reactivity of a PS-DH domain with 3-hydroxyhexanoyl ACP in the microorganism is higher than the reactivity of a FabA-DH domain with 3-hydroxyhexanoyl ACP in the microorganism,
wherein the microorganism has an anaerobic pathway involving a protein complex having PUFA-PKS activity,
wherein proteins constituting the protein complex having PUFA-PKS activity are one of the following combinations (i) to (v):
(i) PhoA, PhoB, PhoC, PhoD, EpaE, AraB,
(ii) EpaA, PhoB, PhoC, PhoD, EpaE, AraB,
(iii) EpaA, AraB, AraC, AraD, EpaE,
(iv) PhoA, AraB, AraC, AraD, EpaE, and
(v) OrfA, OrfB, OrfC, EpaE, AraB, and
wherein
the amino acid sequence of AraB is SEQ ID NO: 58,
the amino acid sequence of AraC is SEQ ID NO: 60,
the amino acid sequence of AraD is SEQ ID NO: 62,
the amino acid sequence of PhoA is SEQ ID NO: 66,
the amino acid sequence of PhoB is SEQ ID NO: 68,
the amino acid sequence of PhoC is SEQ ID NO: 70,
the amino acid sequence of PhoD is SEQ ID NO: 72,
the amino acid sequence of EpaA is SEQ ID NO: 74,
the amino acid sequence of EpaE is SEQ ID NO: 82,
the amino acid sequence of OrfA is SEQ ID NO: 84,
the amino acid sequence of OrfB is SEQ ID NO: 86 or 90, and
the amino acid sequence of OrfC is SEQ ID NO: 88 or 92, or
(II) a microorganism capable of producing a ω-6 PUFA, in which genes encoding respective domains described in the following (a) to (j) having a PUFA-PKS activity have been introduced into a microorganism that does not have a PUFA metabolic pathway:
(a) a KS domain;
(b) a MAT domain;
(c) an ACP domain;
(d) a KR domain;
(e) a PS-DH domain;
(f) a CLF domain;
(g) an AT domain;
(h) a FabA-DH domain;
(i) an ER domain; and
(j) a PPT domain,
wherein the reactivity of a PS-DH domain with 3-hydroxyhexanoyl ACP in the microorganism is higher than the reactivity of a FabA-DH domain with 3-hydroxyhexanoyl ACP in the microorganism
wherein the introduced genes are one of the following combinations:
(i) phoA, phoB, phoC, phoD, epaE, araB,
(ii) epaA, phoB, phoC, phoD, epaE, araB,
(iii) epaA, araB, araC, araD, epaE,
(iv) phoA, araB, araC, araD, epaE, and
(v) orfA, orfB, orfC, epaE, araB, and
wherein
the amino acid sequence of the protein encoded by the arab gene is SEQ ID NO: 58,
the amino acid sequence of the protein encoded by the araC gene is SEQ ID NO: 60,
the amino acid sequence of the protein encoded by the araD gene is SEQ ID NO: 62,
the amino acid sequence of the protein encoded by the phoA gene is SEQ ID NO: 66,
the amino acid sequence of the protein encoded by the phoB gene is SEQ ID NO: 68,
the amino acid sequence of the protein encoded by the phoC gene is SEQ ID NO: 70,
the amino acid sequence of the protein encoded by the phoD gene is SEQ ID NO: 72,
the amino acid sequence of the protein encoded by the epaA gene is SEQ ID NO: 74,
the amino acid sequence of the protein encoded by the epaE gene is SEQ ID NO: 82,
the amino acid sequence of the protein encoded by the orfA gene is SEQ ID NO: 84,
the amino acid sequence of the protein encoded by the orfB gene is SEQ ID NO: 86 or 90, and
the amino acid sequence of the protein encoded by the orfC gene is SEQ ID NO: 88 or 92.

11. A method for producing a ω-6 PUFA or a ω-6 PUFA-containing composition, comprising:
culturing the microorganism according to claim 5 in a culture medium so as to produce and accumulate a ω-6 PUFA or a ω-6 PUFA-containing composition in a culture, and
collecting the ω-6 PUFA or the ω-6 PUFA-containing composition from the culture.

* * * * *